US011685953B2

(12) United States Patent
Avivar Valderas et al.

(10) Patent No.: US 11,685,953 B2
(45) Date of Patent: Jun. 27, 2023

(54) BIOMARKERS AND METHODS OF TREATING CANCER

(71) Applicant: ASTRAZENECA AB, Sodertaue (SE)

(72) Inventors: Alvaro Avivar Valderas, Cheshire (GB); Francisco Humberto Cruzalegui, Cheshire (GB); Kevin Hudson, Cheshire (GB); Robert Kenneth McEwen, Cheshire (GB)

(73) Assignee: ASTRAZENECA AB, Sodertalje (SE)

( * ) Notice: Subject to any disclaimer, the term of this patent is extended or adjusted under 35 U.S.C. 154(b) by 687 days.

(21) Appl. No.: 15/760,858

(22) PCT Filed: Sep. 16, 2016

(86) PCT No.: PCT/EP2016/072069
§ 371 (c)(1),
(2) Date: Mar. 16, 2018

(87) PCT Pub. No.: WO2017/046394
PCT Pub. Date: Mar. 23, 2017

(65) Prior Publication Data
US 2021/0130901 A1 May 6, 2021

Related U.S. Application Data

(60) Provisional application No. 62/219,698, filed on Sep. 17, 2015.

(51) Int. Cl.
| | |
|---|---|
| *C12Q 1/68* | (2018.01) |
| *C12Q 1/6886* | (2018.01) |
| *C07D 401/12* | (2006.01) |
| *A61P 35/00* | (2006.01) |
| *A61P 35/02* | (2006.01) |

(52) U.S. Cl.
CPC ......... *C12Q 1/6886* (2013.01); *C07D 401/12* (2013.01); *A61P 35/00* (2018.01); *A61P 35/02* (2018.01); *C12Q 2600/106* (2013.01); *C12Q 2600/156* (2013.01)

(58) Field of Classification Search
None
See application file for complete search history.

(56) References Cited

FOREIGN PATENT DOCUMENTS

| | | |
|---|---|---|
| WO | 2012068106 A2 | 5/2012 |
| WO | 2013075059 A1 | 5/2013 |
| WO | 2014089241 A2 | 6/2014 |

OTHER PUBLICATIONS

Yokomizo et al. PTEN/MMAC1 mutations identified in small cell, but not in non-small cell lung cancers (1998) 17, 475-479 . (Year: 1998).*
Wooten et al. Genetic markers of response to neoadjuvent therapy: Array-based gene expression profiling from serial core biopsies (2001) Breast Cancer Research and Treatment 69:3, 245. (Year: 2001).*
Brugge et al. A New Mutational aktivation in the PI3K Pathway (2007) Cancer Cell 12: 104-107. (Year: 2007).*
Englemen, Targeting PI3K signalling in cancer: opportunities, challenges and limitations (2009) Nature Reviews 9:550-562. (Year: 2009).*
Affymetrix U95 Array (Year: 2009).*
Wong et al. Targeting the PI3K signaling pathway in cancer (2010) Current Opinion in Genetics & Development 20:87-90. (Year: 2010).*
Tsuji et al. Breast cancer cell lines carry cell line-specific genomic alterations that are distinct from aberrations in breast cancer tissues: comparison of the CGH profiles between cancer cell lines and primary cancer tissues (2010) BMC Cancer 10:15, 10 pages. (Year: 2010).*
Hafner et al. Activation of the PI3K/AKT signalling pathway in non-melanoma skin cancer is not mediated by oncogenic PIK3CA and AKT1 hotspot mutations (2010) Experimental Dermatology 19:8 e222-e227. (Year: 2010).*
Dancik et al. A Framework to Select Clinically Relevant Cancer Cell Lines for Investigation by Establishing their Molecular Similarity with Primary Human Cancers (2011) Cancer Research 71(24) 7398-7409. (Year: 2011).*
Ellis et al. Whole-genome analysis informs breast cancer response to aromatase inhibition (2012) Nature 486, 353-360. (Year: 2012 ).*
Hansen et al. Clinical application of high-throughput genomic technologies for treatment selection in breast cancer (2013) Breast Cancer Research 15:R97, 10 pages (Year: 2013).*
Paplomata et al., The PI3K/AKT/mTOR pathway in breast cancer: targets, trials and biomarkers (2014) Thera Adv in Med One 6(4): 154-166. (Year: 2014).*
Ribas et al. AKT Antagonist AZD5363 Influences Estrogen Receptor Function in Endocrine-Resistant Breast Cancer and Synergizes with Fulbestrant (ICI182780) In Vivo (2015) Molecular Cancer Therapeutics 14(9) 2035-2048. (Year: 2015).*
Song et al. Mechanisms Behind Resistance to PI3K Inhibitor Treatment Induced by the PIM Kinase (2018) Molecular Cancer Therapeutics 17(12) 2710-2721. (Year: 2018).*
Hanker et al., Challenges for the Clinical Development of PI3K Inhibitors: Strategies to Improve Their Impact in Solid Tumors (2019) Cancer Discovery 9:482-491. (Year: 2019).*

(Continued)

Primary Examiner — Jehanne S Sitton

(57) ABSTRACT

Biomarkers for the treatment of pathological conditions associated with the PI3K pathway, such as cancer, and methods of using inhibitors of upstream components of the PI3K pathway, such as PI3K-α inhibitors or AKT inhibitors, are described. In particular, there are described biomarkers for patient selection in the treatment of cancer, as well as methods of therapeutic treatment, diagnostic kits and methods of detection, wherein cancers that possess a mutation in an upstream component of the PI3K pathway (such as the PIK3CA gene and/or the AKT gene), and a wild-type MAP3K1 gene and MAP2K4 gene, are more likely to respond favourably to treatment with inhibitors of upstream components of the PI3K pathway.

3 Claims, 8 Drawing Sheets
Specification includes a Sequence Listing.

(56) References Cited

OTHER PUBLICATIONS

Mishra et al. PI3K Inhibitors in Cancer: Clinical Implications and Adverse Effects (2021) Int J Molec Sci 22:3464, 77 pages. (Year: 2021).*

Zhang et al. The Role of PI3K Inhibition in the Treatment of Breast Cancer, Alone or Combined with Immune Checkpoint Inhibitors (2021) Frontiers 8:648663, 10 pages. (Year: 2021).*

Matthew J. Ellis et al.: "Whole-genome analysis informs breast cancer response to aromatase inhibition", Nature, Jun. 10, 2012 (Jun. 10, 2012).

Annett Mueller et al.: "Selective PI3K inhibition by BKM120 and BEZ235 alone or in combination with chemotherapy in wild-type and mutated human gastrointestinal cancer cell lines", Cancer Chemotherapy and Pharmacology, Springer, Berlin, DE, vol. 69, No. 6, Apr. 29, 2012 (Apr. 29, 2012) pp. 1601-1615.

* cited by examiner

PIK3CA mutant cell lines

| Sample Name | AA Mutation | CDS Mutation |
|---|---|---|
| MDA-MB-453 | p.? | c.1405-5C>G |
| BT-20 | p.P539R | c.1616C>G |
| HCC38 | p.W386L | c.1157G>T |
| T47D | p.H1047R | c.3140A>G |
| MCF7 | p.E545K | c.1633G>A |
| MDA-MB-361 | p.E545K | c.1633G>A |
| MDA-MB-361 | p.K567R | c.1700A>G |
| BT-20 | p.H1047R | c.3140A>G |
| MDA-MB-453 | p.H1047R | c.3140A>G |
| OCUB-M | p.K111N | c.333G>C |
| BT-474 | p.D350N | c.1048G>A |
| CAL-148 | p.E542K | c.1624G>A |
| BT-483 | p.H1047R | c.3140A>G |
| HCC1954 | p.E542K | c.1624G>A |
| CAL-51 | p.H1047R | c.3140A>G |
| UACC-893 | p.H1047R | c.3140A>G |
| MFM-223 | p.H1047R | c.3140A>G |
| CAL-148 | p.H1047R | c.3140A>G |
| EFM-19 | p.H1047L | c.3140A>T |

MAP3K1 mutant cell lines

| Sample Name | AA Mutation | CDS Mutation |
|---|---|---|
| AU565 | p.V484V | c.1452C>G |
| HCC1569 | p.L635L | c.1903T>C |
| HCC38 | P1147A | |
| CAMA-1 | p.G709V | c.2126G>T |
| MRK-nu-1 | p.T779fs*62 | c.2332_2333insC |
| MRK-nu-1 | p.G1193S | c.3577G>A |
| MDA-MB-157 | p.T822delT | c.2462_2464delCAA |
| MDA-MB-157 | p.T822P | c.2464A>C |

MAP2K4 mutant cell lines

| Sample Name | AA Mutation | CDS Mutation |
|---|---|---|
| CAL-51 | p.G265D | c.794G>A |
| MDA-MB-415 | p.S280* | c.839C>A |
| HCC1569 | p.P338L | c.1013C>T |

Fig. 1

|  | Compound A IC50 (nM) | Compound B IC50 (nM) | AZD2014 IC50 (nM) |
|---|---|---|---|
| MCF7 parental | 44.59 | 461.2 | 33.22 |
| MCF7 CR2.5 | 66.86 | 852.5 | 53.90 |
| MCF7 CR1.4 | 100.3 | 1897 | 35.47 |
| MCF7 CR1.8 | 102.8 | 2656 | 25.40 |
| H1047R parental | 537.0 | 424.0 | 84.51 |
| H1047R CR2.3 | 1179 | 4916 | 59.01 |
| H1047R CR2.7 | 2269 | 649.8 | 33.95 |

Fig. 5

BIOMARKERS AND METHODS OF TREATING CANCER

CROSS-REFERENCE TO RELATED APPLICATIONS

This application is a U.S. National Stage application of International Application No. PCT/EP2016/072069, filed on Sep. 16, 2016, which claims benefit under 35 U.S.C. § 119(e) of U.S. Provisional Application No. 62/219,698, filed Sep. 17, 2015, each of which is incorporated by reference in its entirety.

REFERENCE TO THE SEQUENCE LISTING

This application incorporates by reference a Sequence Listing submitted with this application as text file entitled SEQLTXT-1, created on Nov. 16, 2017, and having a size of 627 kilobytes.

BACKGROUND

Breast cancer is one of the most prevalent cancers worldwide with over 1,300,000 cases diagnosed and over 450,000 deaths each year. One of the greatest challenges in treating breast cancer is its heterogeneity. The advent of massive DNA sequencing has provided a mutational landscape of breast cancer, and the combination of such massive DNA sequencing with copy-number variation and gene expression data has led to the classification of breast cancer into ten integrative clusters (Curtis C et al., Nature, 2012, 486, 346-352 and Dawson S-J et al., EMBO J, 2013, 32, 617-628). The PI3K/AKT/mTOR signalling pathway is known to be a critical mediator of cancer cell proliferation, survival, metabolism and apoptosis (Fruman and Rommel, Nature Reviews 2014, 13:140-156), and analysis of the ten integrative clusters has shown that phosphoinositide-3-kinase, catalytic, alpha polypeptide (PIK3CA), the gene encoding the alpha isoform of PI3K (PI3Kα), is frequently mutated in several of the estrogen receptor positive (ER+) clusters. Overall, PIK3CA is mutated in 45% of luminal A breast cancer cases (Cancer Genome Atlas Network, Nature, 2012, 490, 61-70). These studies, together with a wide variety of other studies implicating the PIK3CA gene in tumourigenesis (summarised in WO2014/114928) has led to considerable research effort to discover PI3K-α inhibitors for the treatment of cancer. However, the response rates in cancer patients has generally been low and to date no anti-cancer agent has been approved which targets PI3K-α inhibition.

As a main effector of PI3K, AKT is found frequently in breast cancer as a result of growth factor receptor signalling in breast cancer. AKT is activated by phospholipids PIP3 and PIP2 generated by PI3K activity. Membrane bound PDK1 is directly activated by PIP3 and phosphorylates AKT on Thr308 located on the activation loop. In HER2-positive breast cancer, for example, the PI3K pathway is activated resulting in high activity of AKT, as measured by the phosphorylation of Thr308 and Thr473 (mediated by MTORC2). In ER+ breast cancer, activating PIK3CA mutations are prevalent and this overrides the need for growth factor activation to maintain a high level PIP3 and PIP2 and hence pathway activity mediated by AKT. Although not all the signalling effects of PI3K activation should be attributed to AKT signalling, this kinase remains a major node in the pathway and has been the focus of intense effort in drug discovery and development. Inhibitors of AKT isoforms AKT1, AKT2 and AKT3 have been developed and are presently in clinical trials in breast cancer. Activating mutations in AKT1 have been identified in ER+ luminal breast cancer. In more than 80% of mutated cases, codon affected is Glu17 with frequent mutation to Lysine (E17K mutation). In ER+ luminal breast cancer the prevalence of this mutation is around 3%. It is thought that this or other activating mutations would confer sensitivity to AKT inhibitors and this hypothesis is presently being tested in the clinic.

Recent genomic studies of breast cancer patients have also begun to reveal a possible role of mitogen-activated protein kinases (MAPKs) in promoting cell survival or apoptosis in cancer, in particular via inactivating mutations in MAP3K1 and MAP2K4, two upstream MAPKs of the JNK cell-death pathway (Pham T et al., Genes & Cancer, 2013, 4, 419-426). Mutations in MAP3K1 (13-20%) and MAP2K4 (8%) are found in luminal A breast cancers, and simultaneous mutation of both PIK3CA and MAP3K1 has been reported in clinical samples in 11.56% of PIK3CA mutants (Cancer Genome Atlas Network, Nature, 2012, 490, 61-70 and Ellis M et al., 2012, Nature, 486, 353-360).

The mechanism by which the simultaneous mutation of the PIK3CA and MAP3K1/MAP2K4 genes acts to contribute to the response of patients to inhibitors of upstream components of the PI3K pathway (if at all) remains unknown. Furthermore, very little is known about the role (if any) of simultaneous mutations of the AKT and MAP3K1/MAP2K4 genes in the response of such patients. There therefore remains a need to understand the interaction between genetic mutations of upstream components of the PI3K pathway (such as the PIK3CA and AKT genes) and MAP3K1/MAP2K4 gene mutations and their role in tumourogenesis, and the relevance of any such interaction in the treatment of patients with inhibitor(s) of upstream components of the PI3K pathway, such as PI3K-α inhibitors or AKT inhibitors.

SUMMARY

This specification describes biomarkers for the treatment of pathological conditions associated with the PI3K pathway, such as cancer, and methods of using inhibitor(s) of upstream components of the PI3K pathway, such as PI3K inhibitors (for example PI3K-α inhibitors) or AKT inhibitors. In particular, the specification provides biomarkers for patient selection in the treatment of cancer, as well as methods of therapeutic treatment, diagnostic kits and methods of detection.

Described herein is the identification and characterisation of a link between the status of the gene encoding upstream components of the PI3K pathway (such as the PIK3CA gene or AKT gene), the status of the gene encoding MAP3K1 or MAP2K4, and the susceptibility to treatment with inhibitors of upstream components of the PI3K pathway. This therefore provides opportunities, methods and tools for selecting patients for treatment with inhibitors of upstream components of the PI3K pathway, particularly cancer patients, and/or avoiding treatment of patients less likely to respond therapeutically to the treatment thus avoiding unnecessary treatment and any side effects that may be associated with such ineffective treatment.

The present specification relates, in part, to patient selection tools and methods (including personalised medicine). The selection is based on whether the cancer cells to be treated possess wild-type or mutant upstream components of the PI3K pathway (such as wild-type or mutant PIK3CA gene or wild-type or mutant AKT gene), and wild-type or mutant MAP3K1 or MAP2K4 genes. The genetic status of upstream components of the PI3K pathway (such as PIK3CA or AKT) and the MAP3K1 or MAP2K4 gene status can therefore be used as a biomarker of susceptibility to treatment with inhibitors of upstream components of the PI3K pathway. In particular, this specification describes the link between a mutation-positive PIK3CA gene or AKT gene and a mutation-positive MAP3K1 or MAP2K4 gene, and the resulting reduction in sensitivity to treatment with inhibitor(s) of upstream components of the PI3K pathway, such as PI3K-α inhibitors or AKT inhibitors. Alternatively, this specification describes the link between a mutation-positive PIK3CA gene or AKT gene and a wild-type MAP3K1 and MAP2K4 gene, and the resulting increase in sensitivity to treatment with inhibitor(s) of upstream components of the PI3K pathway, such as PI3K-α inhibitors or AKT inhibitors.

In one aspect, a method of treating a patient suffering from cancer is described, the method including: (a) determining, in a sample which is representative of the cancer and was previously isolated from the patient, whether the genetic status of an upstream component of the PI3K pathway is wild type or mutant; (b) determining whether the MAP3K1 gene in the sample is wild type or mutant; (c) determining whether the MAP2K4 gene in the sample is wild type or mutant; and (d) administering to the patient an effective amount of an inhibitor of an upstream component of the PI3K pathway if: (i) the genetic status of the upstream component of the PI3K pathway was determined to be mutant; (ii) the MAP3K1 gene was determined to be wild type; and (iii) the MAP2K4 gene was determined to be wild type.

In another aspect, a method of treating a patient suffering from cancer is described, the method including: (a) determining whether the AKT gene in the patient's cancer cells is wild type or mutant; (b) determining whether the MAP3K1 gene in the patient's cancer cells is wild type or mutant; (c) determining whether the MAP2K4 gene in the patient's cancer cells is wild type or mutant; (d) administering to the patient an effective amount of an AKT inhibitor if the cancer cells harbour: (i) a mutant AKT gene; (ii) a wild type MAP3K1 gene; and (iii) a wild type MAP2K4 gene.

In another aspect, use of an inhibitor of an upstream component of the PI3K pathway for the treatment of cancer, wherein the cancer cells harbor a mutation in an upstream component of the PI3K pathway, a wild type MAP3K1 gene, and a wild type MAP2K4 gene, is described.

In another aspect, a method for deselecting a patient suffering from cancer for treatment is described, the method including: identifying a candidate patient with a cancer potentially susceptible to treatment with an inhibitor of an upstream component of the PI3K pathway; and determining whether the MAP3K1 and MAP2K4 genes in a sample representative of the cancer previously isolated from the candidate patient are wild type or mutant; wherein the patient is deselected for treatment with an inhibitor of an upstream component of the PI3K pathway if the cancer cells harbour a mutant MAP3K1 or MAP2K4 gene.

In another aspect, a method of treating cancer in a patient whose cancer cell gene status of an upstream component of the PI3K pathway, and of MAP3K1 and MAP2K4, has already been determined, the method comprising administering to the patient an effective amount of an inhibitor of an upstream component of the PI3K pathway if the cancer cells harbor a mutation in an upstream component of the PI3K pathway, a wild type MAP3K1 gene, and a wild type MAP2K4 gene, is described.

There is a clear need for biomarkers that will enrich for or select patients whose cancers will respond to treatment with inhibitor(s) of upstream components of the PI3K pathway, such as PI3K-α inhibitors or AKT inhibitors. Patient selection biomarkers that identify the patients who are less likely to respond to an agent are also important in the treatment of cancer, since they reduce the unnecessary treatment of patients with non-responding cancers to the potential side effects of such agents, and allow patients to be selected for treatment who are most likely to benefit from the therapeutic effects.

BRIEF DESCRIPTION OF THE DRAWINGS

FIG. 1 shows the mutational status of PIK3CA, MAP3K1 and MAP2K4 genes in breast cancer cell lines.

FIG. 5 shows a comparison of $IC_{50}$ for proliferation of parental versus MAP3K1-deficient cell lines with Compound A, Compound B and an mTOR inhibitor (AZD2014).

DETAILED DESCRIPTION

Figure 2:
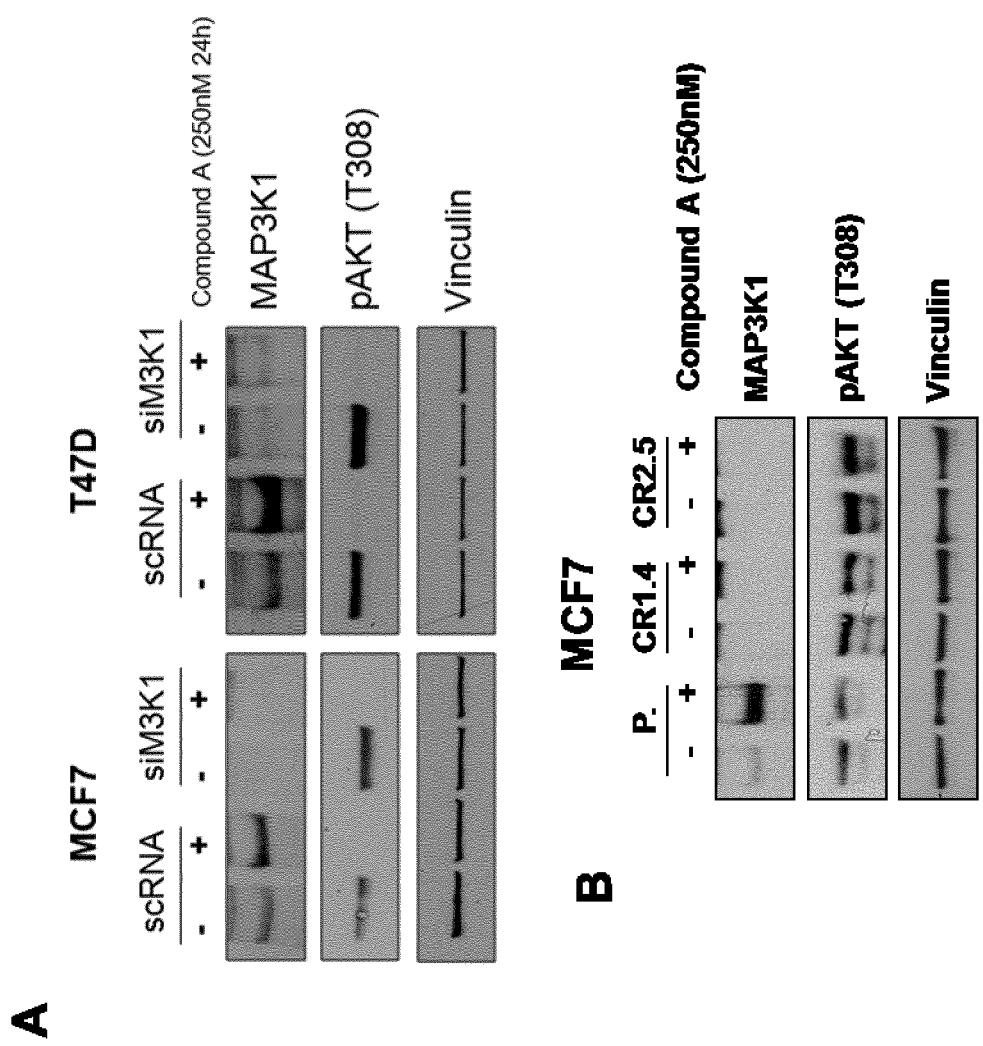
FIG. 2A shows the induction of basal pAKT (T308) levels following siRNA targeting of MAP3K1 mRNA in PIK3CA mutant breast cancer cell lines.
FIG. 2B shows the induction of basal pAKT (T308) levels after MAP3K1 gene disruption and partial resistance to Compound A (PI3Kα and PI3Kδ inhibitor), treatment in mutant cell lines (CR1.4 and CR2.5) when compared to parent (P.) MCF7 cells.

A biomarker can be described as "a characteristic that is objectively measured and evaluated as an indicator of normal biologic processes, pathogenic processes, or pharmacologic responses to a therapeutic intervention". A biomarker is any identifiable and measurable indicator associated with a particular condition or disease where there is a correlation between the presence or level of the biomarker and some aspect of the condition or disease (including the presence of, the level or changing level of, the type of, the stage of, the susceptibility to the condition or disease, or the responsiveness to a drug used for treating the condition or disease). The correlation may be qualitative, quantitative, or both qualitative and quantitative. Typically a biomarker is a compound, compound fragment or group of compounds. Such compounds may be any compounds found in or produced by an organism, including proteins (and peptides), nucleic acids and other compounds.

Biomarkers may have a predictive power, and as such may be used to predict or detect the presence, level, type or stage of particular conditions or diseases (including the presence or level of particular microorganisms or toxins), the susceptibility (including genetic susceptibility) to particular conditions or diseases, or the response to particular treatments (including drug treatments). It is thought that biomarkers will play an increasingly important role in the future of drug discovery and development, by improving the efficiency of research and development programs. Biomarkers can be used as diagnostic agents, monitors of disease progression, monitors of treatment and predictors of clinical outcome. For example, various biomarker research projects are attempting to identify markers of specific cancers and of specific cardiovascular and immunological diseases. It is believed that the development of new validated biomarkers will lead both to significant reductions in healthcare and drug development costs and to significant improvements in treatment for a wide variety of diseases and conditions.

In order to optimally design clinical trials and to gain the most information from these trials, a biomarker may be required. The marker may be measurable in surrogate and cancer cells, or other patient samples where the marker may be detectable. Ideally these markers will also correlate with efficacy and thus could ultimately be used for patient selection.

Thus, the technical problem underlying this aspect of the present invention is the identification of means for stratification of patients for treatment with inhibitor(s) of upstream components of the PI3K pathway, such as PI3K-α inhibitors or AKT inhibitors. The technical problem is solved by provision of the aspects characterized in the claims and/or description herein.

As detailed in the examples herein, it was found that cells that possess a mutation in the MAP3K1 or MAP2K4 gene are generally less susceptible to growth inhibition by inhibitor(s) of upstream components of the PI3K pathway, such as PI3K-α inhibitors or AKT inhibitors. Growth inhibition may occur as the result of inhibition of cell proliferation and/or increased cell death.

The specification provides methods of determining the sensitivity of cells to inhibitor(s) of upstream components of the PI3K pathway, such as PI3K-α inhibitors or AKT inhibitors. The methods comprise determining the status of the genes of upstream components of the PI3K pathway (such as the PIK3CA gene or AKT gene) and the status of the MAP3K1 and MAP2K4 genes in said cells. The cells are identified as likely to be insensitive to an inhibitor of an upstream component of the PI3K pathway if the cells possess a mutation in an upstream component (such as a mutated PIK3CA gene or AKT gene) and the cells possess a mutated MAP3K1 or MAP2K4 gene. Those patients with mutations in the upstream component (such as in the PIK3CA gene or AKT gene) and a mutated MAP3K1 or MAP2K4 gene are therefore predicted to be particularly less sensitive to treatment with an inhibitor an of upstream component of the PI3K pathway, such as a PI3K-α inhibitor or AKT inhibitor. The cells are identified as likely to be sensitive to inhibitors of upstream components of the PI3K pathway if the cells possess a mutation in an upstream component (such as a mutated PIK3CA gene or AKT gene) and the cells possess a wild-type MAP3K1 and MAP2K4 genes. Those patients with a mutation in an upstream component of the PI3K pathway (such as the PIK3CA gene or AKT gene) and wild-type MAP3K1 and MAP2K4 genes are therefore predicted to be particularly sensitive to treatment with an inhibitor of an upstream component of the PI3K pathway, such as PI3K-α inhibitors or AKT inhibitors.

Patients with mutated PIK3CA gene and wild-type MAP3K1 and MAP2K4 genes are predicted to be sensitive to treatment with PI3K-α inhibitors or AKT inhibitors. Patients with mutated AKT gene and wild-type MAP3K1 and MAP2K4 genes are predicted to be sensitive to treatment with AKT inhibitors.

A cell, or population of cells, is sensitive to inhibitor(s) of upstream components of the PI3K pathway if the inhibitor(s) inhibit the increase in cell number in a cell growth assay (either through inhibition of cell proliferation and/or through increased cell death). Methods described herein are useful for predicting which cells, or populations of cells, are more likely to be sensitive to inhibitor(s) of upstream components of the PI3K pathway, such as PI3K-α inhibitors or AKT inhibitors, by growth inhibition.

The present disclosure is further based, in part, on methods that can be used to determine a patient's likely responsiveness to inhibitors of upstream components of the PI3K pathway, including determining whether to administer inhibitor(s) of upstream components of the PI3K pathway, such as PI3K-α inhibitors or AKT inhibitors. Specifically, methods of the present invention include the determination of the gene status (e.g., wild type or mutated) of upstream components of the PI3K pathway (such as PIK3CA gene or AKT gene), and of MAP3K1 and MAP2K4 genes, in a patient's cancer cell(s). The presence of a mutation in an upstream component (such as a mutant PIK3CA gene or AKT gene) and a mutated MAP3K1 or MAP2K4 gene indicates that the cancer cells are less likely to respond by growth inhibition when contacted with inhibitor(s) of upstream components of the PI3K pathway. The gene status (in cancer cells) of the upstream components (such as PIK3CA gene or AKT gene) and of MAP3K1 and MAP2K4 genes can therefore be used to select patients for treatment with inhibitor(s) of said upstream components, such as PI3K-α inhibitors or AKT inhibitors.

Furthermore, an in vitro method for the identification of patient(s) likely to be sensitive to inhibitor(s) of upstream components of the PI3K pathway is disclosed. Also disclosed are uses of oligo- or polynucleotide primers or probes capable of detecting the mutation status of PIK3CA, AKT, MAP3K1, and MAP2K4 genes. Also disclosed are uses of kits for the detection of PIK3CA, AKT, MAP3K1, and MAP2K4 mutations.

Also disclosed are in vitro methods for determining whether a patient suffering from cancer is likely to respond to a pharmaceutical treatment with inhibitor(s) of upstream components of the PI3K pathway, such as PI3K-α inhibitors or AKT inhibitors, said method comprising the steps of: (i) obtaining a sample representative of the cancer that was previously collected from said patient; (ii) determining whether an upstream component of the PI3K pathway (such as the PIK3CA gene or AKT gene) contains a mutation in said sample; and (iii) determining whether the MAP3K1 or MAP2K4 genes contain a mutation in said sample. The absence of a mutation in the MAP3K1 or MAP2K4 gene is indicative of an increased likelihood of a response to treatment with inhibitor(s) of upstream components of the PI3K pathway, such as PI3K-α inhibitors or AKT inhibitors. As a gene biomarker test, identification of cancers that contain wild-type MAP3K1 and MAP2K4 genes will enrich for response to inhibitor(s) of upstream components of the PI3K pathway, such as PI3K-α inhibitors or AKT inhibitors. Individual cancers that contain wild-type MAP3K1 and MAP2K4 genes have the greatest likelihood of responding to inhibitor(s) of upstream components of the PI3K pathway, such as PI3K-α inhibitors or AKT inhibitors.

A second such method comprises the steps of: (i) obtaining a sample representative of the cancer that was previously collected from said patient; (ii) determining whether the PIK3CA gene contains a mutation in said sample; and (iii) determining whether the MAP3K1 or MAP2K4 genes contain a mutation in said sample. A mutation in the PIK3CA gene and the absence of a mutation in the MAP3K1 or MAP2K4 gene is indicative of an increased likelihood of a response to treatment with inhibitor(s) of upstream components of the PI3K pathway, such as PI3K-α inhibitors or AKT inhibitors. As a gene biomarker test, identification of cancers that contain a mutated PIK3CA gene and wild-type MAP3K1 and MAP2K4 genes will enrich for response to inhibitor(s) of upstream components of the PI3K pathway, such as PI3K-α inhibitors or AKT inhibitors. Individual cancers that contain a mutated PIK3CA gene and wild-type MAP3K1 and MAP2K4 gene have the greatest likelihood of responding to inhibitor(s) of upstream components of the PI3K pathway, such as PI3K-α inhibitors or AKT inhibitors.

A further such method comprises the steps of: (i) obtaining a sample representative of the cancer that was previously collected from said patient; (ii) determining whether the AKT gene contains a mutation in said sample; and (iii) determining whether the MAP3K1 or MAP2K4 genes contain a mutation in said sample. A mutation in the AKT gene and the absence of a mutation in the MAP3K1 or MAP2K4 gene is indicative of an increased likelihood of a response to treatment with an AKT inhibitor. As a gene biomarker test, identification of cancers that contain a mutated AKT gene and wild-type MAP3K1 and MAP2K4 genes will enrich for response to an AKT inhibitor. Individual cancers that contain a mutated AKT gene and wild-type MAP3K1 and MAP2K4 genes have the greatest likelihood of responding to an AKT inhibitor.

A sample "representative of the cancer" can be the actual cancer-cell containing sample isolated (e.g. from biopsy or from cell found in the blood), or may be a sample that has been further processed, e.g. a sample of PCR amplified nucleic acid from the cancer cell containing sample, or can be a sample of cancer-derived nucleic acid such as circulating free DNA found in the blood or other bodily fluid of the patient.

Definitions

"AKT inhibitor" is any compound or substance capable of inhibiting any of the isoforms of AKT, also known as protein kinase B. Examples of AKT inhibitors include MK-2206, ipatasertib (GDC-0068), afuresertib (GSK-2110183), 4-amino-N-[(1S)-1-(4-chlorophenyl)-3-hydroxy-propyl]-1-(7H-pyrrolo[2,3-d]pyrimidin-4-yl)piperidine-4-carboxamide, and those described in WO2006/046023, WO2006/046024 and WO2009/047563.

"Allele" refers to a particular form of a genetic locus, distinguished from other forms by its particular nucleotide or amino acid sequence.

"Amplification reactions" are nucleic acid reactions which result in specific amplification of target nucleic acids over non-target nucleic acids. The polymerase chain reaction (PCR) is a well known amplification reaction.

"Cancer" is used herein to refer to neoplastic growth arising from cellular transformation to a neoplastic phenotype. Such cellular transformation often involves genetic mutation.

"Gene" is a segment of DNA that contains all the information for the regulated biosynthesis of an RNA product, including a promoter, exons, introns, and other sequence elements which may be located within 5' or 3' flanking regions (not within the transcribed portions of the gene) that control expression.

"Gene status" refers to whether the gene is wild type or not (i.e. mutant).

"Label" refers to a composition capable of producing a detectable signal indicative of the presence of the target polynucleotide in an assay sample. Suitable labels include radioisotopes, nucleotide chromophores, enzymes, substrates, fluorescent molecules, chemiluminescent moieties, magnetic particles, bioluminescent moieties, and the like. As such, a label is any composition detectable by spectroscopic, photochemical, biochemical, immunochemical, electrical, optical or chemical means.

"Non-synonymous variation" refers to a variation (variance) in or overlapping the coding sequence of a gene that result in the production of a distinct (altered) polypeptide sequence. These variations may or may not affect protein function and include missense variants (resulting in substitution of one amino acid for another), nonsense variants (resulting in a truncated polypeptide due to generation of a premature stop codon) and insertion/deletion variants.

"Synonymous variation" refers to a variation (variance) in the coding sequence of a gene that does not affect sequence of the encoded polypeptide. These variations may affect protein function indirectly (for example by altering expression of the gene), but, in the absence of evidence to the contrary, are generally assumed to be innocuous.

"Nucleic acid" refers to single stranded or double stranded DNA and RNA molecules including natural nucleic acids found in nature and/or modified, artificial nucleic acids having modified backbones or bases, as are known in the art.

"PI3K inhibitor" is any compound or substance capable of inhibiting any one of the isoforms of phosphoinositide-3-kinase (such as the gene products of PIK3CA, PIK3CB, PIK3CD and PIK3CG genes). PI3K inhibitors include PI3K-α, PI3K-β and PI3K-δ inhibitors. Examples of PI3K-β and PI3K-δ inhibitors are (R)-8-(1-(3,5-difluorophenylamino)ethyl)-N,N-dimethyl-2-morpholino-4-oxo-4H-chromene-6-carboxamide and idelalisib.

"PI3K-α inhibitor" is any compound or substance capable of inhibiting the alpha-isoform of phosphoinositide-3-kinase. Examples of PI3K-α inhibitors include BYL719, GDC0032, 1-(4-(5-(5-amino-6-(5-tert-butyl-1,3,4-oxadiazol-2-yl)pyrazin-2-yl)-1-ethyl-1H-1,2,4-triazol-3-yl)piperidin-1-yl)-3-hydroxypropan-1-one, and those described in WO2009/080705, WO2010/029082, WO2011/000905 and WO2014/114928.

"Primer" refers to a single stranded DNA oligonucleotide sequence capable of acting as a point of initiation for synthesis of a primer extension product which is complementary to the nucleic acid strand to be copied. The length and sequence of the primer must be such that they are able to prime the synthesis of extension products. A typical primer contains at least about 7 nucleotides in length of a sequence substantially complementary to the target sequence, but somewhat longer primers are preferred. Usually primers contain about 15-26 nucleotides, but longer or shorter primers may also be employed.

"Polymorphic site" is a position within a locus at which at least two alternative sequences are found in a population.

"Polymorphism" refers to the sequence variation observed in an individual at a polymorphic site. Polymorphisms include nucleotide substitutions, insertions, deletions and microsatellites and may, but need not, result in detectable differences in gene expression or protein function. In the absence of evidence of an effect on expression or protein function, common polymorphisms, including non-synonomous variants, are generally considered to be included in the definition of wild-type gene sequence. A catalog of human polymorphisms and associated annotation, including validation, observed frequencies, and disease association, is maintained by NCBI (dbSNP: http://www.ncbi.nlm.nih.gov/projects/SNP/). Please note that the term "polymorphism" when used in the context of gene sequences should not be confused with the term "polymorphism" when used in the context of solid state form of a compound, that is the crystalline or amorphous nature of a compound. The skilled person will understand the intended meaning by its context.

"Probe" refers to single stranded sequence-specific oligonucleotides which have a sequence that is exactly complementary to the target sequence of the allele to be detected.

"Response" is defined by measurements taken according to Response Evaluation Criteria in Solid Tumours (RECIST) involving the classification of patients into two main groups: those that show a partial response or stable disease and those that show signs of progressive disease.

"Survival" encompasses a patient's overall survival and progression-free survival. "Overall survival" (OS) is defined as the time from the initiation of drug administration to death from any cause. "Progression-free survival" (PFS) is defined as the time from the initiation of drug administration to first appearance of progressive disease or death from any cause.

"Upstream components of the PI3K pathway" refers to the genetic components of the PI3K pathway which are upstream of mTOR (and do not include mTOR). Upstream components of the PI3K pathway include isoforms of PI3K (including PIK3CA, PIK3CB, PIK3CD and PIK3CG genes), isoforms of AKT (including the AKT1, AKT2 and AKT3 genes), PTEN, PDK1, SGK, INPP4B, INPP5D, PIK3R1 and PIK3R2, and in particular PIK3CA and AKT (such as AKT1 and AKT2). Inhibitors of upstream components of the PI3K pathway include PI3K inhibitors (such as PI3K-α, PI3K-β and PI3K-δ inhibitors, for example PI3K-α inhibitors) and AKT inhibitors.

Methods of Selection for Treatment

According to one aspect there is provided a method for selecting a treatment for a patient suffering from cancer, the method comprising providing a sample representative of the cancer from a patient; determining whether the genetic status of an upstream component of the PI3K pathway in the patient's sample representative of the cancer is wild type or mutant; determining whether the MAP3K1 and MAP2K4 genes in the patient's sample are wild type or mutant; and selecting a patient for treatment with an inhibitor of an upstream component of the PI3K pathway based thereon.

According to another aspect there is provided a method for selecting a treatment for a patient suffering from cancer, the method comprising providing a sample representative of the cancer from a patient; determining whether the PIK3CA gene or AKT gene in the patient's sample representative of the cancer is wild type or mutant; determining whether the MAP3K1 and MAP2K4 genes in the patient's sample are wild type or mutant; and selecting a patient for treatment with an inhibitor of an upstream component of the PI3K pathway, such as a PI3K-α inhibitor or AKT inhibitor, based thereon.

The method may include or exclude the actual patient sample isolation step. Thus, according to one aspect there is provided a method for selecting a treatment for a patient suffering from cancer, the method comprising determining whether the genetic status of an upstream component of the PI3K pathway in a sample representative of the cancer previously isolated from the patient is wild type or mutant; determining whether the MAP3K1 and MAP2K4 genes in the sample previously isolated from the patient are wild type or mutant; and selecting a patient for treatment with an inhibitor of an upstream component of the PI3K pathway, such as a PI3K-α inhibitor or AKT inhibitor, based thereon.

In another aspect, there is provided a method for selecting a treatment for a patient suffering from cancer, the method comprising determining whether the PIK3CA gene or the AKT gene in a sample representative of the cancer previously isolated from the patient is wild type or mutant; determining whether the MAP3K1 and MAP2K4 genes in the sample previously isolated from the patient are wild type or mutant; and selecting a patient for treatment with an inhibitor of an upstream component of the PI3K pathway, such as a PI3K-α inhibitor or AKT inhibitor, based thereon.

In one aspect the method comprises the determination of the status of the PIK3CA gene.

In another aspect, the patient is selected for treatment with an inhibitor of an upstream component of the PI3K pathway, such as a PI3K-α inhibitor or AKT inhibitor, if the cancer cell DNA has a mutant PIK3CA gene and wild-type MAP3K1 and MAP2K4 genes.

In another aspect, the method comprises the determination of the status of the AKT gene.

In another aspect, the patient is selected for treatment with an inhibitor of an upstream component of the PI3K pathway, such as an AKT inhibitor, if the cancer cell DNA has a mutant AKT gene and wild-type MAP3K1 and MAP2K4 genes.

In another aspect, a patient is not selected for treatment with an inhibitor of an upstream components of the PI3K pathway, if the cancer cell DNA possesses a mutant PIK3CA gene or mutant AKT gene, and a mutant MAP3K1 gene or mutant MAP2K4 gene.

According to another aspect there is provided a method for selecting a patient for treatment with a PI3K-α inhibitor, the method comprising determining whether the PIK3CA gene in a sample representative of the cancer previously isolated from the patient is wild type or mutant; determining whether the MAP3K1 and MAP2K4 genes in the sample previously isolated from the patient are wild type or mutant; and selecting a patient for treatment with a PI3K-α inhibitor based thereon.

According to another aspect there is provided a method for selecting a patient for treatment with an AKT inhibitor, the method comprising determining whether the PIK3CA gene in a sample representative of the cancer previously isolated from the patient is wild type or mutant; determining whether the MAP3K1 and MAP2K4 genes in the sample previously isolated from the patient are wild type or mutant; and selecting a patient for treatment with an AKT inhibitor based thereon.

According to another aspect there is provided a method for selecting a patient for treatment with an AKT inhibitor, the method comprising determining whether the AKT gene in a sample representative of the cancer previously isolated from the patient is wild type or mutant; determining whether the MAP3K1 and MAP2K4 genes in the sample previously isolated from the patient are wild type or mutant; and selecting a patient for treatment with an AKT inhibitor based thereon.

According to a further aspect there is provided a method for selecting a patient for treatment with an inhibitor of an upstream component of the PI3K pathway, such as a PI3K-α inhibitor or an AKT inhibitor, the method comprising determining whether the PIK3CA gene or AKT gene in a sample representative of the cancer previously isolated from the patient is wild type or mutant; determining whether the MAP3K1 gene in the sample previously isolated from the patient is wild type or mutant; and selecting a patient for treatment with the inhibitor based thereon.

In one aspect, the patient is selected for treatment with an inhibitor of an upstream component of the PI3K pathway, such as a PI3K-α inhibitor or an AKT inhibitor, if the cancer cell DNA has a mutant PIK3CA gene or a mutant AKT gene, and a wild-type MAP3K1 gene. In other aspects, is not selected for treatment with a PI3K-α inhibitor if the cancer cell DNA has a mutant PIK3CA gene or a mutant AKT gene, and a mutant MAP3K1 gene.

In another aspect there is provided a method for selecting a patient for treatment with an inhibitor of an upstream component of the PI3K pathway, such as a PI3K-α inhibitor or an AKT inhibitor, the method comprising determining whether the PIK3CA gene or AKT gene in a sample representative of the cancer previously isolated from the patient is wild type or mutant; determining whether the MAP2K4 gene in the sample previously isolated from the patient is wild type or mutant; and selecting a patient for treatment with the inhibitor based thereon.

In one aspect, the patient is selected for treatment with an inhibitor of an upstream component of the PI3K pathway, such as a PI3K-α inhibitor or an AKT inhibitor, if the cancer cell DNA has a mutant PIK3CA gene or a mutant AKT gene, and a wild-type MAP2K4 gene. In other aspects, a patient is not selected for treatment with a PI3K-α inhibitor if the cancer cell DNA has a mutant PIK3CA gene or a mutant AKT gene, and a mutant MAP2K4 gene.

According to another aspect there is provided a method for predicting a patient's responsiveness to inhibitor(s) of upstream components of the PI3K pathway, such as PI3K-α inhibitors or AKT inhibitors, the method comprising determining whether the PIK3CA gene or AKT gene in the patient's cancer cells is wild type or mutant; determining whether the MAP3K1 gene and MAP2K4 gene in the patient's cancer cells are wild type or mutant; and based thereon, predicting a patient's responsiveness to treatment with inhibitor(s) of upstream components of the PI3K pathway, such as PI3K-α inhibitors or AKT inhibitors.

According to another aspect there is provided a method for determining the likelihood of effectiveness of treatment with inhibitor(s) of upstream components of the PI3K pathway, such as PI3K-α inhibitors or AKT inhibitors, in a human patient affected with cancer comprising: determining whether the PIK3CA gene or AKT gene in the patient's cancer cells is wild type or mutant; determining whether the MAP3K1 gene and MAP2K4 gene in the patient's cancer cell are wild type or mutant; and based thereon, predicting a patient's responsiveness to treatment with inhibitor(s) of upstream components of the PI3K pathway, such as PI3K-α inhibitors or AKT inhibitors.

According to another aspect there is provided a method for deselecting a patient for treatment with an inhibitor of an upstream component of the PI3K pathway, such as a PI3K-α inhibitor or an AKT inhibitor, the method comprising determining whether the MAP3K1 gene and MAP2K4 gene in a cancer cell containing sample previously isolated from the patient are wild type or mutant, and wherein the patient is not selected for treatment with the inhibitor if the cancer cell DNA possesses a mutant MAP3K1 gene or mutant MAP2K4 gene.

Methods of Treatment

According to another aspect there is provided a method of treating cancer in a patient whose cancer cell gene status of an upstream component of the PI3K pathway, and of MAP3K1 and MAP2K4, has already been determined, the method comprising administering to the patient an effective amount of an inhibitor of an upstream component of the PI3K pathway if the cancer cells possess a mutant gene for an upstream component of the PI3K pathway, and wild type MAP3K1 and MAP2K4 genes.

According to another aspect there is provided a method of treating cancer in a patient whose cancer cell PIK3CA or AKT gene status, and MAP3K1 and MAP2K4 gene status, has already been determined, the method comprising administering to the patient an effective amount of an inhibitor of an upstream component of the PI3K pathway, such as a PI3K-α inhibitor or an AKT inhibitor, if the cancer cells possess a mutant PIK3CA gene or a mutant AKT gene, and wild type MAP3K1 and MAP2K4 genes.

In another aspect, there is provided a method of treating cancer in a patient whose cancer cell PIK3CA, MAP3K1, and MAP2K4 gene status has already been determined, the method comprising administering to the patient an effective amount of an inhibitor of an upstream component of the PI3K pathway, such as a PI3K-α inhibitor or an AKT inhibitor, if the cancer cells possess a mutant PIK3CA gene, and wild type MAP3K1 and MAP2K4 genes.

In another aspect, there is provided a method of treating cancer in a patient whose cancer cell AKT, MAP3K1, and MAP2K4 gene status has already been determined, the method comprising administering to the patient an effective amount of an inhibitor of an upstream component of the PI3K pathway, such as an AKT inhibitor, if the cancer cells possess a mutant AKT gene, and wild type MAP3K1 and MAP2K4 genes.

In another aspect, there is provided a method of treating a patient suffering from cancer comprising: determining the mutant or wild type status of the PIK3CA gene or AKT gene in the patient's cancer cells; determining the mutant or wild type status of the MAP3K1 and MAP2K4 genes in the patient's cancer cells; and administering to the patient an effective amount of an inhibitor of an upstream component of the PI3K pathway, such as a PI3K-α inhibitor or an AKT inhibitor, if the cancer cells possess a mutant PIK3CA gene or mutant AKT gene, and wild type MAP3K1 and MAP2K4 genes.

According to a further aspect there is provided a method of treating a patient suffering from cancer, comprising providing a sample representative of the cancer from a patient; determining whether the genetic status of an upstream component of the PI3K pathway in the patient's cancer cells is wild type or mutant; determining whether the MAP3K1 gene and MAP2K4 gene in the patient's cancer cells are wild type or mutant; and administering to the patient an effective amount of an inhibitor of an upstream component of the PI3K pathway, such as a PI3K-α inhibitor or an AKT inhibitor, if the cancer cells possess a mutation in an upstream component of the PI3K pathway, and wild type MAP3K1 and MAP2K4 genes.

According to a further aspect there is provided a method of treating a patient suffering from cancer comprising providing a sample representative of the cancer from a patient; determining whether the PIK3CA gene or AKT gene in the patient's cancer cells are wild type or mutant; determining whether the MAP3K1 and MAP2K4 genes in the patient's cancer cells are wild type or mutant; and administering to the patient an effective amount of an inhibitor of an upstream component of the PI3K pathway, such as a PI3K-α inhibitor or an AKT inhibitor, if the cancer cells possess a mutant PIK3CA gene or mutant AKT gene, and wild type MAP3K1 and MAP2K4 genes.

In a further aspect there is provided a method of treating a patient suffering from cancer comprising providing a sample representative of the cancer from a patient; determining whether the PIK3CA gene in the patient's cancer cells is wild type or mutant; determining whether the MAP3K1 and MAP2K4 genes in the patient's cancer cells are wild type or mutant; and administering to the patient an effective amount of an inhibitor of an upstream component of the PI3K pathway, such as a PI3K-α inhibitor or an AKT inhibitor, if the cancer cells possess a mutant PIK3CA gene, and wild type MAP3K1 and MAP2K4 genes.

In a further aspect, there is provided a method of treating a patient suffering from cancer comprising providing a cancer cell containing sample from a patient; determining whether the AKT gene in the patient's cancer cells is wild type or mutant; determining whether the MAP3K1 and MAP2K4 genes in the patient's cancer cells are wild type or mutant; and administering to the patient an effective amount of an inhibitor of an upstream component of the PI3K pathway, such as a PI3K-α inhibitor or an AKT inhibitor, if the cancer cells possess a mutant AKT gene, and wild type MAP3K1 and MAP2K4 genes.

As used herein, the terms "effective" and "effectiveness" includes both pharmacological effectiveness and physiological safety. Pharmacological effectiveness refers to the ability of the treatment to result in a desired biological effect in the patient. Physiological safety refers to the level of toxicity, or other adverse physiological effects at the cellular, organ and/or organism level (often referred to as side-effects) resulting from administration of the treatment. "Less effective" means that the treatment results in a therapeutically significant lower level of pharmacological effectiveness and/or a therapeutically greater level of adverse physiological effects.

Methods of Screening

According to another aspect there is provided a method of screening patients to establish suitability for treatment with an inhibitor of an upstream component of the PI3K pathway comprising determining whether the genetic status of an upstream component of the PI3K pathway in a sample representative of the cancer previously isolated from the patient is wild type or mutant; and determining whether the MAP3K1 and MAP2K4 genes in the sample previously isolated from the patient are wild type or mutant.

According to another aspect there is provided a method of screening patients to establish suitability for treatment with an inhibitor of an upstream component of the PI3K pathway, such as a PI3K-α inhibitor or an AKT inhibitor, comprising determining whether the PIK3CA gene or AKT gene in a sample representative of the cancer previously isolated from the patient is wild type or mutant; and determining whether the MAP3K1 and MAP2K4 genes in the sample previously isolated from the patient are wild type or mutant.

In a further aspect, there is provided a method of screening patients to establish suitability for treatment with an inhibitor of an upstream component of the PI3K pathway, such as a PI3K-α inhibitor or an AKT inhibitor, comprising determining whether the PIK3CA gene in a sample representative of the cancer previously isolated from the patient is wild type or mutant; and determining whether the MAP3K1 and MAP2K4 genes in the sample previously isolated from the patient are wild type or mutant.

In a further aspect, there is provided a method of screening patients to establish suitability for treatment with an inhibitor of an upstream component of the PI3K pathway, such as a PI3K-α inhibitor or an AKT inhibitor, comprising determining whether the AKT gene in a sample representative of the cancer previously isolated from the patient is wild type or mutant; and determining whether the MAP3K1 and MAP2K4 genes in the sample previously isolated from the patient are wild type or mutant.

Inhibitors and Uses Thereof

According to another aspect there is provided the use of an inhibitor of an upstream component of the PI3K pathway to treat a cancer patient whose cancer cells have been identified as possessing a mutation in an upstream component of the PI3K pathway, and wild type MAP3K1 and MAP2K4 genes.

According to another aspect there is provided the use of an inhibitor of an upstream component of the PI3K pathway, such as a PI3K-α inhibitor or an AKT inhibitor, to treat a cancer patient whose cancer cells have been identified as possessing a mutant PIK3CA gene or a mutant AKT gene, and wild type MAP3K1 and MAP2K4 genes.

In another aspect, there is provided the use of an inhibitor of an upstream component of the PI3K pathway, such as a PI3K a inhibitor or an AKT inhibitor, to treat a cancer patient whose cancer cells have been identified as possessing a mutant PIK3CA gene, and wild type MAP3K1 and MAP2K4 genes.

In a further aspect, there is provided the use of an inhibitor of an upstream component of the PI3K pathway, such as a PI3K-α inhibitor or an AKT inhibitor, to treat a cancer patient whose cancer cells have been identified as possessing a mutant AKT gene, and wild type MAP3K1 and MAP2K4 genes.

According to another aspect there is provided an inhibitor of an upstream component of the PI3K pathway for use in the treatment of cancers with cancer cells identified as harbouring a mutation in an upstream component of the PI3K pathway, and wild type MAP3K1 and MAP2K4 genes.

According to another aspect there is provided an inhibitor of an upstream component of the PI3K pathway, such as a PI3K-α inhibitor or an AKT inhibitor, for use in the treatment of cancers with cancer cells identified as harbouring a mutant PIK3CA gene, or a mutant AKT gene and wild type MAP3K1 and MAP2K4 genes.

In a further aspect there is provided an inhibitor of an upstream component of the PI3K pathway, such as a PI3K-α inhibitor or an AKT inhibitor, for use in the treatment of cancers with cancer cells identified as harbouring a mutant PIK3CA gene, and wild type MAP3K1 and MAP2K4 genes.

In a further aspect there is provided an inhibitor of an upstream component of the PI3K pathway, such as a PI3K-α inhibitor or an AKT inhibitor, for use in the treatment of cancers with cancer cells identified as harbouring a mutant AKT gene, and wild type MAP3K1 and MAP2K4 genes.

In a further aspect, there is provided an inhibitor of an upstream component of the PI3K pathway, such as a P3K-α inhibitor or an AKT inhibitor, for use in the treatment of cancers with cancer cells identified as harbouring a mutant PIK3CA gene, or a mutant AKT gene and a wild type MAP3K1 gene.

In a further aspect, there is provided an inhibitor of an upstream component of the PI3K pathway, such as a PI3K-α inhibitor or an AKT inhibitor, for use in the treatment of cancers with cancer cells identified as harbouring a mutant PIK3CA gene, or a mutant AKT gene and a wild type MAP2K4 gene.

According to another aspect there is provided the use an inhibitor of an upstream component of the PI3K pathway for the manufacture of a medicament for use in the treatment of cancers with cancer cells identified as harbouring a mutation in an upstream component of the PI3K pathway, and wild type MAP3K1 and MAP2K4 genes.

According to another aspect there is provided the use an inhibitor of an upstream component of the PI3K pathway, such as a PI3K-α inhibitor or an AKT inhibitor, for the manufacture of a medicament for use in the treatment of cancers with cancer cells identified as harbouring a mutant PIK3CA gene or a mutant AKT gene, and wild type MAP3K1 and MAP2K4 genes.

In a further aspect there is provided the use of an inhibitor of an upstream component of the PI3K pathway, such as a PI3K-α inhibitor or an AKT inhibitor, for the manufacture of a medicament for use in the treatment of cancers with cancer cells identified as harbouring a mutant PIK3CA gene, and wild type MAP3K1 and MAP2K4 genes.

In a further aspect there is provided the use of an inhibitor of an upstream component of the PI3K pathway, such as a PI3K-α inhibitor or an AKT inhibitor, for the manufacture of a medicament for use in the treatment of cancers with cancer cells identified as harbouring a mutant AKT gene, and wild type MAP3K1 and MAP2K4 genes.

In a further aspect, there is provided the use an inhibitor of an upstream component of the PI3K pathway, such as a PI3K-α inhibitor or an AKT inhibitor, for the manufacture of a medicament for use in the treatment of cancers with cancer cells identified as harbouring a mutant PIK3CA gene, or a mutant AKT gene and a wild type MAP3K1 gene.

In a further aspect, there is provided the use of an inhibitor of an upstream component of the PI3K pathway, such as a PI3K-α inhibitor or an AKT inhibitor, for the manufacture of a medicament for use in the treatment of cancers with cancer cells identified as harbouring a mutant PIK3CA gene, or a mutant AKT gene and a wild type MAP2K4 gene.

In a further aspect, the invention relates to a pharmaceutical composition comprising an inhibitor of an upstream component of the PI3K pathway for use in the prevention and treatment of cancer with cancer cells identified as harbouring a mutation in an upstream component of the PI3K pathway, and wild type MAP3K1 and MAP2K4 genes.

In still further aspects, the invention relates to a pharmaceutical composition comprising an inhibitor of an upstream component of the PI3K pathway, such as a PI3K-α inhibitor or an AKT inhibitor, for use in the prevention and treatment of cancer with cancer cells identified as harbouring a mutant PIK3CA gene or a mutant AKT gene, and wild type MAP3K1 and MAP2K4 genes.

The pharmaceutical compositions can take the form of solutions, suspensions, emulsions, tablets, pills, pellets, capsules, capsules containing liquids, powders, sustained-release formulations, suppositories, aerosols, sprays, suspensions, or any other form suitable for use.

Administration may be, for example, topical (i.e., the pharmaceutical composition is applied directly where its action is desired), enteral or oral (i.e., the pharmaceutical composition is given via the digestive tract), or parenteral (i.e., the pharmaceutical composition is given by other routes than the digestive tract such as by injection).

In one aspect, the active compound or salt thereof (an inhibitor of an upstream component of the PI3K pathway, such as a PI3K-α inhibitor or AKT inhibitor) and optionally another therapeutic or prophylactic agent are formulated in accordance with routine procedures as pharmaceutical compositions adapted for intravenous administration to human beings. Typically, the active compound for intravenous administration are solutions in sterile isotonic aqueous buffer. Where necessary, the compositions can also include a solubilizing agent. Compositions for intravenous administration can optionally include a local anaesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule. Where the active compound is to be administered by infusion, it can be dispensed, for example, with an infusion bottle containing sterile pharmaceutical grade water or saline. Where the active compound is administered by injection, an ampoule of sterile water for injection or saline can be provided so that the ingredients can be mixed prior to administration.

Compositions for oral delivery can be in the form of tablets, lozenges, aqueous or oily suspensions, granules, powders, emulsions, capsules, syrups, or elixirs, for example. Orally administered compositions can contain one or more optional agents, for example, sweetening agents such as fructose, aspartame or saccharin; flavouring agents such as peppermint, oil of wintergreen, or cherry; colouring agents; and preserving agents, to provide a pharmaceutically palatable preparation. A time delay material such as glycerol monostearate or glycerol stearate can also be used. Oral compositions can include standard vehicles such as mannitol, lactose, starch, magnesium stearate, sodium saccharine, cellulose, magnesium carbonate, and the like. Such vehicles are of pharmaceutical grade in particular aspects.

Compositions for use in accordance with the present invention can be formulated in conventional manner using one or more physiologically acceptable carriers or excipients. Thus, the active compound and optionally another therapeutic or prophylactic agent and their physiologically acceptable salts and solvates can be formulated into pharmaceutical compositions for administration by inhalation or insufflation (either through the mouth or the nose) or oral, parenteral or mucosal (such as buccal, vaginal, rectal, sublingual) administration. In one aspect, local or systemic parenteral administration is used.

For oral administration, the compositions can take the form of, for example, tablets or capsules prepared by conventional means with pharmaceutically acceptable excipients such as binding agents (e.g., pregelatinised maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations can also contain buffer salts, flavouring, colouring and sweetening agents as appropriate.

In some aspects, compounds or salts disclosed herein or can be administered as a pharmaceutical composition in which the pharmaceutical composition comprises between 0.1-1 mg, 1-10 mg, 10-50 mg, 50-100 mg, 100-500 mg, or 500 mg to 5 g of said active compound or salt thereof.

According to a yet further aspect there is provided a kit comprising an inhibitor of an upstream component of the PI3K pathway, such as a PI3K-α inhibitor or an AKT inhibitor, in a suitable unit dosage form; a test suitable to provide the results of an analysis to determine whether the patient has a wild type or mutant upstream component of the PI3K pathway (such as the PIK3CA gene or AKT gene); a test suitable to provide the results of an analysis to determine whether the patient has wild type or mutant MAP3K1 and MAP2K4 genes; container means for containing the inhibitor of an upstream component of the PI3K pathway, such as a PI3K-α inhibitor or an AKT inhibitor, and the PI3K pathway upstream component, MAP3K1 and MAP2K4 tests; and optionally instructions for use.

According to a yet further aspect there is provided a kit comprising an inhibitor of an upstream component of the PI3K pathway, such as a PI3K-α inhibitor or an AKT inhibitor, in a suitable unit dosage form; a test suitable to provide the results of an analysis to determine whether the patient has a wild type or mutant PIK3CA gene; a test suitable to provide the results of an analysis to determine whether the patient has wild type or mutant MAP3K1 and MAP2K4 genes; container means for containing the inhibitor of an upstream component of the PI3K pathway, such as a PI3K-α inhibitor or an AKT inhibitor, and the PIK3CA, MAP3K1 and MAP2K4 tests; and optionally instructions for use.

In a yet further aspect there is provided a kit comprising an AKT inhibitor in a suitable unit dosage form; a test suitable to provide the results of an analysis to determine whether the patient has a wild type or mutant AKT gene; a test suitable to provide the results of an analysis to determine whether the patient has wild type or mutant MAP3K1 and MAP2K4 genes; container means for containing the AKT inhibitor, and the AKT, MAP3K1 and MAP2K4 tests; and optionally instructions for use.

Gene Status: Wild-Type or Mutant

For the purpose of this specification, a gene status of wild-type is meant to indicate normal or appropriate expression of the gene and normal function of the encoded protein. In contrast, mutant status is meant to indicate abnormal or inappropriate gene expression, or expression of a protein with altered function, consistent with the known roles of mutant upstream components of the PI3K pathway (such as PIK3CA or AKT) and of MAP3K and MAP2K4 in cancer (as described herein). Any number of genetic or epigenetic alterations, including but not limited to mutation, amplification, deletion, genomic rearrangement, or changes in methylation profile, may result in a mutant status. However, if such alterations nevertheless result in appropriate expression of the normal protein, or a functionally equivalent variant, then the gene status is regarded as wild-type. Examples of variants that typically would not result in a functional mutant gene status include synonymous coding variants and common polymorphisms (synonymous or non-synonymous). As discussed below, gene status can be assessed by a functional assay, or it may be inferred from the nature of detected deviations from a reference sequence.

In certain aspects the wild-type or mutant status of the upstream component of the PI3K pathway (such as the PIK3CA or AKT genes) and/or the MAP3K1 and MAP2K4 genes is determined by the presence or absence of non-synonymous nucleic acid variations in the genes. Observed non-synonymous variations corresponding to known common polymorphisms with no annotated functional effects do not contribute to a gene status of mutant.

Other variations in the genes of upstream components of the PI3K pathway (such as the PIK3CA gene or AKT gene) and/or MAP3K1/MAP2K4 genes that signify mutant status include splice site variations that decrease recognition of an intron/exon junction during processing of pre-mRNA to mRNA. This can result in exon skipping or the inclusion of normally intronic sequence in spliced mRNA (intron retention or utilization of cryptic splice junctions). This can, in turn, result in the production of aberrant protein with insertions and/or deletions relative to the normal protein. Thus, in other aspects, the gene has a mutant status if there is a variant that alters splice site recognition sequence at an intron/exon junction.

Non-synonymous, protein expression or activity depleting mutations, and/or loss of function mutations in the genes of upstream components of the PI3K pathway (such as the PIK3CA gene or AKT gene) and/or MAP3K1/MAP2K4 genes are particularly relevant for use in the aspects described herein and provide separate aspects of the present disclosure. In further aspects, such mutations may be frameshift mutations, splice-cite mutations, nonsense mutations and/or missense mutations.

Characterisation of PIK3CA Mutations

WO2014/114928 describes a survey conducted at AstraZeneca on breast cancers (based on COSMIC database (Welcome Trust Sanger Institute, September 2011), in which >55 different mutations in the PIK3CA gene were identified from across a dataset covering >5K human tumours. The majority of mutations occurred at <1% frequency, 3 occurred at 1-3% frequency, but 4 mutations accounted for 88% of total PIK3CA mutations. These were kinase domain missense mutations in the C terminal kinase domain, H1047R (55%) and H1047L (5%), and the helical domain residues, E545K (18%) and E542K (11%). A longer list of other prevalent breast cancer mutations, although not intended to be exhaustive, encompasses R38H, R38C, R88Q, N345K, C420R, E453Q, P539R, E542K, E545K, E545A, Q546K, Q546P, M1043I, M1043V, H1047R, H1047L, H1047Y. Hence diagnostic assays can be built that focus on detection of the most common mutations, thereby allowing identification of the majority of PIK3CA mutations. For example the Cobas™ PIK3CA Mutation Test from Roche Molecular Systems is designed to detect 17 mutations in exons 1, 4, 7, 9 and 20 of the PIK3CA gene (E542K, E545A, E545G, E545K, E545D, Q546K, Q546R, Q546E, Q546L, N345K, C420R, R88Q, H1047L, H1047R, H1047Y, G1049R and M1043I) in DNA isolated from formalin-fixed paraffin-embedded tumour samples. This kit is capable of picking up to ~95% of mutations in ER+ve breast cancer. The distribution of mutations differs across other tumour types and the diagnostic strategy may be adapted accordingly. For example, in endometrial cancer, there is a more even distribution of mutations spread throughout the PIK3CA gene coding sequence and with larger number of mutations in the N terminal region of the protein (communicated by Douglas A. Levine, M. D, TCGA 2nd Annual Symposium, Nov. 28, 2012), compared with breast cancers.

For PIK3CA, reference sequences are available for the gene (GenBank accession number: NG_012113), mRNA (GenBank accession number: NM_006218), and protein (GenBank accession number: NP_006209 or Swiss-Prot accession: P42336). Particular reference sequences are shown in SEQ ID NO: 5, 10, 15 and 20, respectively. The reference gene (genomic region) sequences include 5000 bases of upstream sequence and 2000 bases of downstream sequence. Mutations within PIK3CA are well known (COSMIC database—Welcome Trust Sanger Institute), and the person of skill in the art will be able to determine the PIK3CA gene status, i.e. whether a particular PIK3CA gene is wild type or mutant, based on comparison of DNA or protein sequence with wild type.

It will be apparent that the gene and mRNA reference sequences disclosed for PIK3CA are each a representative sequence, and for the purposes of the present disclosure, the preferred protein reference sequence for comparative purposes only is shown at SEQ ID NO. 20. In normal individuals there are two copies of each gene, a maternal and paternal copy, which will likely have some sequence differences, moreover within a population there will exist numerous allelic variants of the gene sequence. Other sequences regarded as wild type include those that possess one or more synonymous changes to the nucleic acid sequence (which changes do not alter the encoded protein sequence), non-synonymous common polymorphisms (e.g. germ-line polymorphisms) which alter the protein sequence but do not affect protein function, and intronic non-splice-site sequence changes.

Characterisation of AKT Mutations

AKT1 missense point mutations have been identified in human cancers including breast (see references 1-3 below). In addition to E17K, the most common AKT1 mutation in human cancers, several other mutations (L52R, C77F, and Q79K) have been shown to be functionally transforming (see references 4, 5 below). Given the high sequence identity between the AKT1 and AKT2 proteins (Ensembl database—EMBl-EBI/Wellcome Trust Sanger Institute) it is thought that the corresponding mutations in AKT2 are also transforming.

For AKT1, reference sequences are available for the gene (GenBank accession number: NG_012188), mRNA (GenBank accession number: NM_005163), and protein (GenBank accession number: NP_005154 or Swiss-Prot accession: P31749). Particular reference sequences are shown in SEQ ID NO: 1, 6, 11 and 16, respectively. For AKT2, reference sequences are available for the gene (GenBank accession number: NG_012038), mRNA (GenBank accession number: NM_001626), and protein (GenBank accession number: NP_001617 or Swiss-Prot accession: P31751). Particular reference sequences are shown in SEQ ID NO: 2, 7, 12 and 17, respectively. Mutations within AKT1 and AKT2 occur at relatively low frequencies (COSMIC database—Welcome Trust Sanger Institute), and the person of skill in the art will be able to determine the AKT1 and AKT2 gene status, i.e. whether a particular AKT1 or AKT2 gene is wild type or mutant, based on comparison of DNA or protein sequence with wild type.

It will be apparent that the gene, mRNA sequence and protein reference sequences disclosed for AKT1 and AKT2 are each a representative sequence, and for the purposes of the present disclosure, the preferred protein reference sequence for comparative purposes only is shown at SEQ ID NO. 16 (for AKT1) and at SEQ ID NO. 17 (for AKT2). In normal individuals there are two copies of each gene, a maternal and paternal copy, which is will likely have some sequence differences, moreover within a population there will exist numerous allelic variants of the gene sequence. Other sequences regarded as wild type include those that possess one or more synonymous changes to the nucleic acid sequence (which changes do not alter the encoded protein sequence), non-synonymous common polymorphisms (e.g. germ-line polymorphisms) which alter the protein sequence but do not affect protein function, and intronic non-splice-site sequence changes.

1. Flatley, E. et al. PIK3CA-AKT pathway mutations in micropapillary breast carcinoma. *Human Pathology* (2013) 44, 1320-1327.
2. Stemke-Hale, K. et al. An integrative genomic and proteomic analysis of PIK3CA, PTEN and AKT mutations in breast cancer. *Cancer Research* (2008) 68, 6084-6091.
3. Troxell, M. L. et al. High prevalence of PIK3CA/AKT pathway mutations in papillary neoplasms of the breast. *Modern Pathology* (2010). 23, 27-37.
4. Yi, K. et al. Functional analysis of non-hotspot AKT1 mutants found in human breast cancers identifies novel driver mutations: implications for personalized medicine *Oncotarget* (2012) 4, 29-34.
5. Carpten, J. D., et al. A transforming mutation in the pleckstrin homology domain of AKT1 in cancer. *Nature* (2007) 448, 439-444.

Characterisation of MAP3K1 and/or MAP2K4 Mutations

Several reports in the literature (see references 1-4 below) identified frequent mutations in the MAP3K1 and MAP2K4 genes. Mutations were distributed across the coding sequence of each gene with no apparent enrichment in any functional domain. This pattern is indicative of the gene's function as a tumour suppressor gene in which so-called 'loss-of-function' mutations (splicing, nonsense and frameshift mutations) abrogate expression of functional protein. For MAP3K1, in 19% of cases, mutations lead to a non-synonymous change in the coding sequence (Pham et al Genes and Cancer 2014, 4:410-426) but in the majority of cases mutations are frameshift deletions or insertions (59% of mutations). Examples are frameshift mutations such as R273fs*27. I761fs*35 and nonsense mutations such as S431* and S1344*. Hence diagnostic assays can be built that focus on detection of loss-of-function mutations, thereby allowing identification of MAP3K1 and MAP2K4 mutations. For MAP3K1 and MAP2K4 reference sequences are available for the gene, mRNA and protein (Table 1). The SEQ ID NO. of particular reference sequences are shown in Table 1 below.

TABLE 1

| Sequence | MAP3K1 | SEQ ID NO | MAP2K4 | SEQ ID NO |
|---|---|---|---|---|
| RefSeq Gene | NG_031884 | 4 | NG_033952 | 3 |
| RefSeq mRNA | NM_005921 | 9 | NM_003010 | 8 |
| RefSeq protein | NP_005912 | 14 | NP_003001 | 13 |
| SWISS-PROT protein | Q13233 | 19 | P45985 | 18 |

Mutations within MAP3K1 and MAP2K4 are well known (COSMIC database—Welcome Trust Sanger Institute), and the person of skill in the art will be able to determine the gene status, i.e. whether a particular MAP3K1 or MAP2K4 gene is wild type or mutant, based on comparison of DNA or protein sequence with wild type.

It will be apparent that the gene and mRNA and protein reference sequences disclosed for MAP3K1 and the MAP2K4 are each a representative sequence, and for the purposes of the present disclosure, the preferred protein reference sequence for comparative purposes only is shown at SEQ ID NO. 19 (for MAP3K1) and at SEQ ID NO. 18 (for MAP2K4). In normal individuals there are two copies of each gene, a maternal and paternal copy, which will likely have some sequence differences, moreover within a population there will exist numerous allelic variants of the gene sequence. Other sequences regarded as wild type include those that possess one or more synonymous changes to the nucleic acid sequence (which changes do not alter the encoded protein sequence), non-synonymous common polymorphisms (e.g. germ-line polymorphisms) which alter the protein sequence but do not affect protein function, and intronic non-splice-site sequence changes.

1. The Cancer Genome Atlas Network. Comprehensive molecular portraits of human breast tumours. *Nature* (2012) 490, 61-70.
2. Stephens, P. J. et al. The landscape of cancer genes and mutational processes in breast cancer. *Nature* (2012) 486, 400-404.
3. Ellis, M. J. et al. Whole-genome analysis informs breast cancer response to aromatase inhibition. *Nature* (2012) 486, 353-60.
4. Curtis, C. et al. The genomic and transcriptomic architecture of 2,000 breast tumours reveals novel subgroups. *Nature* (2012) 486, 346-352.

Methods for Determining the Likelihood of Effectiveness of Treatment

According to another aspect there is provided a method for determining the likelihood of effectiveness of treatment with an inhibitor of an upstream component of the PI3K pathway, such as a PI3K-α inhibitor or AKT inhibitor, in a human patient affected with cancer comprising: detecting the presence or absence of at least one non-synonymous nucleic acid variance in an upstream component of the PI3K pathway (such as the PIK3CA gene or AKT gene) of said patient relative to the wild type gene; detecting the presence or absence of at least one non-synonymous nucleic acid variance in the MAP3K1 gene and MAP2K4 gene of said patient relative to the wild type genes; wherein the presence of at least one non-synonymous nucleic acid variance in the upstream component of the PI3K pathway (such as the PIK3CA gene or AKT gene) and the absence of at least one non-synonymous nucleic acid variance in both the MAP3K1 gene and MAP2K4 gene indicates that treatment with an inhibitor of an upstream component of the PI3K pathway, such as a PI3K-α inhibitor or AKT inhibitor is likely to be effective.

According to another aspect there is provided a method for assessing the susceptibility of an individual to treatment with an inhibitor of an upstream component of the PI3K pathway, such as a PI3K-α inhibitor or AKT inhibitor, which method comprises:

(i) determining the non-synonymous mutation status of an upstream component of the PI3K pathway (such as the PIK3CA gene or AKT gene) in cancer cell DNA from the individual;
(ii) determining the non-synonymous mutation status of the MAP3K1 gene and MAP2K4 gene in cancer cell DNA from the individual; and
(iii) determining the likely susceptibility of the individual to treatment with an inhibitor of an upstream component of the PI3K pathway, such as a PI3K-α inhibitor or AKT inhibitor, by reference to the non-synonymous mutation status of the upstream component of the PI3K pathway (such as the PIK3CA gene or AKT gene), and the MAP3K1 gene and MAP2K4 gene in the cancer cells.

There are numerous techniques available to the person skilled in the art to determine the gene status of PIK3CA. The gene status can be determined by determination of the nucleic acid sequence. This could be via direct sequencing of the full-length gene or analysis of specific sites within the gene, e.g. commonly mutated sites.

An alternative means for determining whether or not the PIK3CA gene is wild type or mutant is to assess the function of the transcribed gene. Functional mutation of this PIK3CA gene produces a protein that has increased lipid kinase activity resulting in increased downstream signalling of the pathway in cells, including, but not limited to, activation of Akt and S6 kinase. The assays to assess the functional status of PIK3CA variants when expressed in cells include but are not limited to:

(i) increased production of the product of the kinase activity of the PIK3CA gene, phosphatidylinositol-trisphosphate (PI(3,4,5)P3);
(ii) increased levels of phosphorylated Akt or S6 kinase;
(iii) increased focus and colony formation of NIH-3T3 cells transfected with the variant of PIK3CA; (Ikenoue T et al., *Cancer Res.*, 2005 65, 4562-4567).

An alternative means for profiling the relevant DNA samples involves Massively Parallel Sequencing (also known as Next Generation Sequencing, or NGS). Massively Parallel Sequencing methods may be used to determine the genotypes of these genes and are exemplified by, but not limited to, the Illumina, Ion Torrent, Sequenom and Oxford Nanopore platforms.

Samples

The patient's sample to be tested for the gene status can be any cancer tissue or cancer-cell containing sample obtained or obtainable from the individual, or a sample containing cancer nucleic acid, such as circulating free DNA (cfDNA) that might be found in blood/plasma or other bodily fluid. The test sample is conveniently a sample of blood, mouth swab, biopsy, or other body fluid or tissue obtained from an individual. Particular examples include: circulating cancer cells, circulating DNA in the plasma or serum, cells isolated from the ascites fluid of ovarian cancer patients, lung sputum for patients with cancers within the lung, a fine needle aspirate from a breast cancer patient, urine, peripheral blood, a cell scraping, a hair follicle, a skin punch or a buccal sample.

It will be appreciated that the test sample may equally be a nucleic acid sequence corresponding to the sequence in the test sample, that is to say that all or a part of the region in the sample nucleic acid may firstly be amplified using any convenient technique e.g. polymerase chain reaction (PCR), before analysis. The nucleic acid may be genomic DNA or fractionated or whole cell RNA. In particular aspects the RNA is whole cell RNA and is used directly as the template for labelling a first strand cDNA using random primers or poly A primers. The nucleic acid or protein in the test sample may be extracted from the sample according to standard methodologies (see Green & Sambrook, Eds., Molecular Cloning: A Laboratory Manual, (2012, 4th edition, Vol. 1-3, ISBN 9781936113422), Cold Spring Harbor Laboratory Press, Cold Spring Harbor, N.Y.).

The diagnostic methods of the invention can be undertaken using a sample previously taken from the individual or patient. Such samples may be preserved by freezing or fixed and embedded in formalin-paraffin or other media. Alternatively, a fresh cancer cell containing sample may be obtained and used.

The methods disclosed in this specification can be applied using cells from any suitable cancer. Suitable cancers for treatment are described herein.

Prevalence of Mutations

Mutations in PIK3CA are found broadly in clinical tumours, but the prevalence of mutations in each gene varies significantly by tumour tissue type. For example, PIK3CA mutations are relatively common in breast cancer but relatively rare in kidney tumours (Table 2).

TABLE 2

Prevalence of PIK3CA mutations in clinical samples. Source for PIK3CA information is the COSMIC database (release v62). The patient selection methods of the disclosure may be particularly useful in the disease (tissue) segments where there is a high incidence of PIK3CA mutations (e.g. breast, urinary tract, endometrium, large intestine, cervix etc.).

| Tissue | PIK3CA mutation prevalence (%) |
|---|---|
| Penis | 29 |
| Endometrium | 26 |
| Breast | 26 |
| Small intestine | 20 |
| Urinary tract | 17 |
| Skin | 13 |
| Large intestine | 12 |
| Stomach | 9 |
| Biliary tract | 9 |
| Ovary | 9 |
| Cervix | 8 |
| Oesophagus | 6 |
| Liver | 6 |
| Upper aerodigestive tract | 6 |
| CNS | 5 |
| NS | 5 |
| Lung | 4 |
| Thyroid | 4 |
| Pituitary | 3 |
| Soft tissue | 3 |
| Pancreas | 3 |
| Kidney | 2 |
| Prostate | 2 |
| Meninges | 1 |
| Eye | 1 |
| Autonomic ganglia | 1 |
| Haematopoietic/lymphoid | 1 |
| Adrenal gland | 0 |
| Bone | 0 |
| Fallopian tube | 0 |
| Gastrointestinal tract (site indeterminate) | 0 |
| Peritoneum | 0 |
| Salivary gland | 0 |
| Testis | 0 |
| Thymus | 0 |
| Vagina | 0 |

Mutations in AKT1 and AKT2 are found broadly in clinical tumours, with the prevalence of mutations varying by tumour tissue type (Tables 3 and 4).

TABLE 3

Prevalence of AKT1 mutations in clinical cancer cohorts. The patient selection methods of the disclosure may be particularly useful in the disease (tissue) segments where there is a high incidence of AKT1 mutations.

| Tissue | AKT1 mutation prevalence (%) |
|---|---|
| Bladder | 3 |
| Breast | 2.4 |
| Uterine | 1.6 |
| Cervical | 1.5 |

TABLE 3-continued

Prevalence of AKT1 mutations in clinical cancer cohorts. The patient selection methods of the disclosure may be particularly useful in the disease (tissue) segments where there is a high incidence of AKT1 mutations.

| Tissue | AKT1 mutation prevalence (%) |
|---|---|
| Colorectal | 1.4 |
| Prostate | 1.3 |
| Lung adeno | 1.2 |
| Medulloblastoma | 1.1 |
| Stomach | 1 |
| Liver | 0.9 |
| Melanoma | 0.9 |
| Head & neck | 0.7 |
| Pancreas | 0.7 |
| Thyroid | 0.7 |
| Lung squamous | 0.6 |
| Kidney Renal Papillary Cell Carcinoma | 0.6 |
| Kidney Renal Clear Cell Carcinoma | 0.5 |
| Multiple Myeloma | 0.5 |
| Acute Myeloid Leukemia | 0.3 |
| Glioblastoma Multiforme | 0.3 |
| Ovarian | 0.2 |

TABLE 4

Prevalence of AKT2 mutations in clinical cancer cohorts. The patient selection methods of the disclosure may be particularly useful in the disease (tissue) segments where there is a high incidence of AKT2 mutations.

| Tissue | AKT2 mutation prevalence (%) |
|---|---|
| Melanoma | 2.5 |
| Uterine | 2.5 |
| Stomach | 2.4 |
| Colorectal | 2.4 |
| Pancreas | 1.4 |
| Lung adeno | 1.3 |
| Kidney Renal Papillary Cell Carcinoma | 1.2 |
| Melanoma | 1.1 |
| Head & neck | 1.1 |
| Liver | 1 |
| Kidney Renal Clear Cell Carcinoma | 0.7 |
| Prostate | 0.7 |
| Cervical | 0.5 |
| Breast | 0.3 |
| Thyroid | 0.3 |

Mutations in MAP3K1 are found in many cancer types including breast, stomach and uterine cancers (Table 5). Although the prevalence in all breast cancer studies combined is around 6%, it can be higher in specific types of breast cancer. For example, 75% of the alterations seen in breast cancer are found in luminal A, HER2negative/ER+ cancer where the prevalence of MAP3K1 mutations can be between 11% and 16%.

TABLE 5

Prevalence of MAP3K1 mutations in clinical samples. Source for MAP3K1 information is the cBioPortal database. The patient selection methods of the disclosure may be particularly useful in the disease (tissue) segments where there is a high incidence of MAP3K1 mutations

| Tissue | MAP3K1 mutation prevalence (%) |
|---|---|
| Breast | 6 |
| Stomach | 4.5 |
| Uterine | 2.9 |

TABLE 5-continued

Prevalence of MAP3K1 mutations in clinical samples. Source for MAP3K1 information is the cBioPortal database. The patient selection methods of the disclosure may be particularly useful in the disease (tissue) segments where there is a high incidence of MAP3K1 mutations

| Tissue | MAP3K1 mutation prevalence (%) |
|---|---|
| Bladder | 0.9 |
| Stomach | 0.7 |
| Kidney Renal Papillary Cell Carcinoma | 0.6 |
| Kidney Renal Clear Cell Carcinoma | 0.5 |
| Colorectal | 0.5 |
| Lung adeno | 0.5 |
| Melanoma | 0.4 |
| Thyroid | 0.3 |

Mutations in MAP2K4 are found in many cancer types including breast, colon, pancreas and stomach (Table 6). Although the prevalence in all breast cancer studies combined is around 3%, it can be higher in specific types of breast cancer. For example, 75% of the alterations seen in breast cancer are found in luminal A HER2-negative/ER+ cancer where the prevalence of MAP2K4 mutations can be between 8% and 10.

TABLE 6

Prevalence of MAP2K4 mutations in clinical samples. Source for MAP2K4 information is the cBioPortal database. The patient selection methods of the disclosure may be particularly useful in the disease (tissue) segments where there is a high incidence of MAP2K4 mutations

| Tissue | MAP2K4 mutation prevalence (%) |
|---|---|
| Breast | 3 |
| Colorectal | 2.8 |
| Esophagus | 0.7 |
| Head and neck | 0.4 |
| Lung adeno | 0.4 |
| Ovarian | 0.3 |
| Pancreas | 1 |
| Stomach | 1 |
| Uterine CS | 1.8 |

As will be evident to anyone skilled in the art, this frequency data is continually being refined and updated as new and more comprehensive data emerges from Human Cancer Genome profiling consortia such as the TCGA (The Cancer Genome Atlas) and ICGC (International Cancer Genome Consortium). Hence additional tumour types with PIK3CA or AKT dependency and MAP3K1 and/or MAP2K4 dependency may be identified and be eligible for treatment with inhibitors of upstream components of the PI3K pathway, such as PI3K-α inhibitors or AKT inhibitors, as described herein.

Relevant Indications

Where the treatment of cancer is indicated, it is to be understood that this may refer to the prevention of metastases and the treatment of metastases, i.e. cancer spread. Therefore the methods disclosed herein might be used to treat a patient who has no metastases to stop them occurring, or to lengthen the time period before they occur, and to a patient who already has metastases to treat the metastases themselves. Furthermore the treatment of cancer may refer to treatment of an established primary tumour or tumours and developing primary tumour or tumours.

Therefore, in one aspect the treatment of cancer relates to the prevention of metastases.

In another aspect the treatment of cancer relates to the treatment of metastases.

In another aspect the treatment of cancer relates to treatment of an established primary tumour or tumours or developing primary tumour or tumours.

Herein, the treatment of cancer may refer to the prevention of cancer per se.

In one aspect, where cancer is referred to, it may refer to tumours which are sensitive to inhibition of upstream components of the PI3K pathway that are involved in the signal transduction steps which lead to the proliferation, survival, invasiveness and migratory ability of tumour cells.

In one aspect, the cancer is one which carries a mutation in an upstream component of the PI3K pathway, such as the PIK3CA or AKT gene.

In one aspect, the cancer is one which displays PIK3CA-dependency or AKT-dependency, based on mutation, amplification, or other aberration.

In one aspect, the cancer is selected from breast cancer, gastric cancer, esophageal cancer, lung cancer, head and neck cancer, endometrial cancer, ovarian cancer, cervical cancer, vulval cancer, multiple myeloma, lymphoma, leukemia, bladder cancer, brain cancer, colorectal cancer, gall bladder cancer, bile duct cancer, skin cancer, pancreatic cancer, testicular cancer, thyroid cancer, kidney cancer, liver cancer, vulval cancer, penile cancer and other PI3-kinase dependent cancers.

In one aspect the cancer is breast cancer.

In one aspect the cancer is estrogen receptor positive breast cancer.

In one aspect the cancer is estrogen receptor positive luminal breast cancer.

In one aspect the cancer is estrogen receptor positive luminal A breast cancer.

In one aspect the cancer is in a metastatic state.

In one aspect the cancer is in a non-metastatic state.

Methods for Detection of Nucleic Acids

The detection of mutant upstream components of the PI3K pathway (such as PIK3CA or AKT) and of mutant MAP3K1 or MAP2K4 nucleic acids can be employed, in the context of the present invention, to predict the response to drug treatment. Since mutations in these genes occur at the DNA level, the methods of the invention can be based on detection of mutations or variances in genomic DNA, as well as transcripts and proteins themselves. It can be desirable to confirm mutations in genomic DNA by analysis of transcripts and/or polypeptides, in order to ensure that the detected mutation is indeed expressed in the subject.

It will be apparent to the person skilled in the art that there are a large number of analytical procedures which may be used to detect the presence or absence of variant nucleotides at one or more positions in a gene. In general, the detection of allelic variation requires a mutation discrimination technique, optionally an amplification reaction (such as one based on polymerase chain reaction) and optionally a signal generation system. There are a multitude of mutation detection techniques available in the art and these may be used in combination with a signal generation system, of which there are numerous available in the art. Many methods for the detection of allelic variation are reviewed by Nollau et al., *Clin. Chem.*, 1997, 43, 1114-1120; Anderson S M. *Expert Rev Mol Diagn.*, 2011, 11, 635-642; Meyerson M. et al., *Nat Rev Genet.*, 2010, 11, 685-696; and in standard textbooks, for example "*Laboratory Protocols for Mutation Detection*", Ed. by U. Landegren, Oxford University Press, 1996 and "PCR", 2nd Edition by Newton & Graham, BIOS Scientific Publishers Limited, 1997.

As noted above, determining the presence or absence of a particular variance or plurality of variances in the PIK3CA gene in a patient with cancer can be performed in a variety of ways. Such tests are commonly performed using DNA or RNA collected from biological samples, e.g., tissue biopsies, urine, stool, sputum, blood, cells, tissue scrapings, breast aspirates or other cellular materials, and can be performed by a variety of methods including, but not limited to, PCR, hybridization with allele-specific probes, enzymatic mutation detection, chemical cleavage of mismatches, mass spectrometry or DNA sequencing, including minisequencing.

Suitable mutation detection techniques include amplification refractory mutation system (ARMS™), amplification refractory mutation system linear extension (ALEX™), competitive oligonucleotide priming system (COPS), Taqman, Molecular Beacons, restriction fragment length polymorphism (RFLP), and restriction site based PCR and fluorescence resonance energy transfer (FRET) techniques.

The skilled person will be aware that similar techniques to those described above may be used to detect mutations in the AKT and/or the MAP3K1/MAP2K4 genes. In particular aspects the method employed for determining the nucleotide (s) within a biomarker gene is selected from: allele-specific amplification (allele specific PCR)—such as amplification refractory mutation system (ARMS), sequencing, allelic discrimination assay, hybridisation, restriction fragment length polymorphism (RFLP) or oligonucleotide ligation assay (OLA).

In particular aspects, hybridization with allele specific probes can be conducted by: (1) allele specific oligonucleotides bound to a solid phase (e.g. glass, silicon, nylon membranes) with the labelled sample in solution, for example as in many DNA chip applications; or, (2) bound sample (often cloned DNA or PCR amplified DNA) and labelled oligonucleotides in solution (either allele specific or short so as to allow sequencing by hybridization). Diagnostic tests may involve a panel of variances, often on a solid support, which enables the simultaneous determination of more than one variance. Such hybridization probes are well known in the art (see, e.g., Green & Sambrook, Eds., Molecular Cloning: A Laboratory Manual, (2012, 4th edition, Vol. 1-3, ISBN 9781936113422), Cold Spring Harbor Laboratory Press, Cold Spring Harbor, N.Y.) and may span two or more variance sites.

Thus, in one aspect, the detection of the presence or absence of at least one mutation provides for contacting PIK3CA or AKT nucleic acid and/or MAP3K1 and MAP2K4 nucleic acid containing a putative mutation site with at least one nucleic acid probe. The probe preferentially hybridizes with a nucleic acid sequence including a variance site and containing complementary nucleotide bases at the variance site under selective hybridization conditions. Hybridization can be detected with a detectable label using labels known to one skilled in the art. Such labels include, but are not limited to radioactive, fluorescent, dye, and enzymatic labels.

In another aspect, the detection of the presence or absence of at least one mutation provides for contacting PIK3CA or AKT nucleic acid and/or MAP3K1 and MAP2K4 nucleic acid containing a putative mutation site with at least one nucleic acid primer. The primer preferentially hybridizes with a nucleic acid sequence including a variance site and containing complementary nucleotide bases at the variance site under selective hybridization conditions.

Oligonucleotides used as primers for specific amplification may carry the complementary nucleotide base to the mutation of interest in the centre of the molecule (so that amplification depends on differential hybridization; see, e.g., Gibbs, et al., 1989. *Nucl. Acids Res.*, 17, 2437-248) or at the extreme 3'-terminus of one primer where, under appropriate conditions, mismatch can prevent, or reduce polymerase extension (see, e.g., Prossner, 1993, *Tibtech*, 11 238).

In yet another aspect, the detection of the presence or absence of at least one mutation comprises sequencing at least one nucleic acid sequence and comparing the obtained sequence with the known wild type nucleic acid sequence.

Alternatively, the presence or absence of at least one mutation comprises mass spectrometric determination of at least one nucleic acid sequence.

In one aspect, the detection of the presence or absence of at least one nucleic acid variance comprises performing a polymerase chain reaction (PCR). The target nucleic acid sequence containing the hypothetical variance is amplified and the nucleotide sequence of the amplified nucleic acid is determined. Determining the nucleotide sequence of the amplified nucleic acid comprises sequencing at least one nucleic acid segment. Alternatively, amplification products can be analyzed using any method capable of separating the amplification products according to their size, including automated and manual gel electrophoresis, and the like.

Mutations in genomic nucleic acid are advantageously detected by techniques based on mobility shift in amplified nucleic acid fragments. For instance, Chen et al., *Anal Biochem* 1996, 239, 61-9, describe the detection of single-base mutations by a competitive mobility shift assay. Moreover, assays based on the technique of Marcelino et al., *BioTechniques* 1999, 26, 1134-1148 are available commercially.

In a particular example, capillary heteroduplex analysis may be used to detect the presence of mutations based on mobility shift of duplex nucleic acids in capillary systems as a result of the presence of mismatches.

Generation of nucleic acids for analysis from samples generally requires nucleic acid amplification. Many amplification methods rely on an enzymatic chain reaction (such as a polymerase chain reaction, a ligase chain reaction, or a self-sustained sequence replication) or from the replication of all or part of the vector into which it has been cloned. Preferably, the amplification according to the invention is an exponential amplification, as exhibited by for example the polymerase chain reaction.

Many target and signal amplification methods have been described in the literature, for example, general reviews of these methods in Landegren, U., et al., *Science*, 1988 242, 229-237 and Lewis, R., *Genetic Engineering News* 1990, 10, 54-55. These amplification methods can be used in the methods of the invention, and include polymerase chain reaction (PCR), PCR in situ, ligase amplification reaction (LAR), ligase hybridisation, Qβ bacteriophage replicase, transcription-based amplification system (TAS), genomic amplification with transcript sequencing (GAWTS), nucleic acid sequence-based amplification (NASBA) and in situ hybridisation. Primers suitable for use in various amplification techniques can be prepared according to methods known in the art.

Polymerase Chain Reaction (PCR) is a nucleic acid amplification method described inter alia in U.S. Pat. Nos. 4,683,195 and 4,683,202. PCR consists of repeated cycles of DNA polymerase generated primer extension reactions. The target DNA is heat denatured and two oligonucleotides, which bracket the target sequence on opposite strands of the DNA to be amplified, are hybridised. These oligonucleotides become primers for use with DNA polymerase. The DNA is copied by primer extension to make a second copy of both strands. By repeating the cycle of heat denaturation, primer hybridisation and extension, the target DNA can be amplified a million fold or more in about two to four hours. PCR is a molecular biology tool, which must be used in conjunction with a detection technique to determine the results of amplification. An advantage of PCR is that it increases sensitivity by amplifying the amount of target DNA by 1 million to 1 billion fold in approximately 4 hours. PCR can be used to amplify any known nucleic acid in a diagnostic context (Mok et al., *Gynaecologic Oncology*, 1994, 52: 247-252,).

An allele specific amplification technique such as Amplification Refractory Mutation System (ARMS™) (Newton et al., *Nucleic Acids Res.*, 1989, 17, 2503-2516) can also be used to detect single base mutations. Under the appropriate PCR amplification conditions, a single base mismatch located at the 3'-end of the primer is sufficient for preferential amplification of the perfectly matched allele (Newton et al., 1989, supra), allowing the discrimination of closely related species. The basis of an amplification system using the primers described above is that oligonucleotides with a mismatched 3'-residue will not function as primers in the PCR under appropriate conditions. This amplification system allows genotyping solely by inspection of reaction mixtures after agarose gel electrophoresis.

Analysis of amplification products can be performed using any method capable of separating the amplification products according to their size, including automated and manual gel electrophoresis, mass spectrometry, and the like.

The methods of nucleic acid isolation, amplification and analysis are routine for one skilled in the art and examples of protocols can be found, for example, Green & Sambrook, Eds., Molecular Cloning: A Laboratory Manual, (2012, 4th edition, Vol. 1-3, ISBN 9781936113422), Cold Spring Harbor Laboratory Press, Cold Spring Harbor, N.Y.) Particularly useful protocol source for methods used in PCR amplification is *PCR (Basics: From Background to Bench)* by M. J. McPherson, S. G. Mailer, R. Beynon, C. Howe, Springer Verlag; 1st edition (Oct. 15, 2000), ISBN: 0387916008.

The present specification also describes predictive and diagnostic kits comprising degenerate primers to amplify a target nucleic acid in the PIK3CA gene or AKT gene, and/or the MAP3K1 gene and MAP2K4 gene and instructions comprising: amplification protocol and analysis of the results. The kit may alternatively also comprise buffers, enzymes, and containers for performing the amplification and analysis of the amplification products. The kit may also be a component of a screening, or diagnostic kit comprising other tools such as DNA microarrays, or other supports. Preferably, the kit also provides one or more control templates, such as nucleic acids isolated from normal tissue sample, and/or a series of samples representing different variances in the reference genes.

In one aspect, the kit provides two or more primer pairs, each pair capable of amplifying a different region of the reference (PIK3CA or AKT, and/or MAP3K1 and MAP2K4) gene (each region a site of potential variance) thereby providing a kit for analysis of expression of several gene variances in a biological sample in one reaction or several parallel reactions.

Primers in the kits may be labelled, for example fluorescently labelled, to facilitate detection of the amplification products and consequent analysis of the nucleic acid variances. The kit may also allow for more than one variance to be detected in one analysis. A combination kit will therefore comprise of primers capable of amplifying different segments of the reference gene. The primers may be differentially labelled, for example using different fluorescent labels, so as to differentiate between the variances.

Also disclosed are use of kits for the detection of PIK3CA or AKT and/or MAP3K1 and MAP2K4 mutations, including but not limited to, PIK3CA mutation detection kits and AKT mutation detection kits which are presently marketed.

For all the aspects above, mutant forms of PIK3CA determined/identified are at all positions across the gene.

For all the aspects above, using tumours such as breast cancer as an example, particular mutant forms of PIK3CA determined/identified are those at positions R38, R88, N345, C420, E453, P539, E542K, E545K, Q546, M1043, M1043 and H1047R.

For all the aspects above, using tumours such as breast cancer as an example, particular mutant forms of PIK3CA determined/identified are those at positions E542, E545 and H1047.

For all the aspects above, mutant forms of AKT determined/identified are at all positions across the gene.

For all the aspects above, using tumours such as breast cancer as an example, particular mutant forms of AKT determined/identified are those at positions E17K, L52R, C77F and Q79K.

For all the aspects above, using tumours such as breast cancer as an example, a particular mutant form of AKT determined/identified is at positions E17K.

For all the aspects above, mutant forms of MAP3K1 determined/identified are at all positions across the gene.

For all the aspects above, mutant forms of MAP3K1 determined/identified are those forms characterised by mutation which leads to a premature translational stop.

For all the aspects above, mutant forms of MAP3K1 determined/identified are those forms characterised by mutations leading to loss of function.

For all the aspects above, mutant forms of MAP3K1 determined/identified are those forms characterised by a mutation which leads to a non-synonymous change in the coding sequence.

For all the aspects above, mutant forms of MAP3K1 determined/identified are those at positions R273fs*27. I761fs*35, S431* and S1344*.

For all the aspects above, mutant forms of MAP2K4 determined/identified are at all positions across the gene.

For all the aspects above, mutant forms of MAP2K4 determined/identified are those forms characterised by mutation which leads to a premature translational stop.

For all the aspects above, mutant forms of MAP2K4 determined/identified are those forms characterised by mutations leading to loss of function.

For all the aspects above, mutant forms of MAP2K4 determined/identified are those forms characterised by a mutation which leads to a non-synonymous change in the coding sequence.

For all the aspects above, mutant forms of MAP2K4 determined/identified are those at positions R273fs*27. I761fs*35, S431* and S1344*.

Throughout this specification, reference is made to the genetic status of upstream components of the PI3K pathway. For the avoidance of doubt, where any particular aspect is described which encompasses upstream components of the PI3K pathway, there are provided additional aspects which encompass the status of the PI3K genes (including PIK3CA, PIK3CB, PIK3CD and PIK3CD genes), the status of the isoforms of AKT (including the AKT1, AKT2 and AKT3 genes), the status of the PTEN gene, the status of the PDK1 gene, the status of the SGK gene, the status of the INPP4B gene, the status of the INPP5D gene, the status of the PIK3R1 gene, and the status of the PIK3R2 gene. A particular additional aspect is any of the aspects described herein, wherein the status of the PIK3CA gene only is encompassed. A further particular additional aspect is any of the aspects described herein, wherein the status of the AKT gene only is encompassed.

Similarly, and also for the avoidance of doubt, where any particular aspect is described which encompasses both the MAP3K1 and MAP2K4 genes, there is provided an additional aspect which encompasses the status of the MAP3K1 gene only, and a further aspect which encompasses the status of the MAP2K4 gene only.

Furthermore, and also for the avoidance of doubt, where reference is made within this specification to the AKT gene, then an additional aspect is the gene selected from AKT1 and AKT2. A still further aspect, the gene is the AKT1 gene only. In a yet further aspect, the gene is the AKT2 gene only.

Additionally, throughout this specification, reference is made to inhibitors of an upstream component of the PI3K pathway. For the avoidance of doubt, where any particular aspect is described which encompasses an inhibitor of an upstream component of the PI3K pathway, there are provided additional aspects which encompass inhibitors of PI3K isoforms (such as PI3K-α, PI3K-β and PI3K-δ inhibitors), and additional aspects which encompass inhibitors of isoforms of AKT (including the AKT1, AKT2, AKT1/2 and AKT3 inhibitors).

In a still further aspect, where reference is made to an inhibitor of an upstream component of the PI3K pathway the said inhibitor is selected from a PI3K-α inhibitor and an AKT inhibitor.

Similarly, where any particular aspect encompasses the selection of an inhibitor from a PI3K-α inhibitor and an AKT inhibitor, there is provided an additional aspect wherein said inhibitor is a PI3K-α inhibitor only, and an additional aspect wherein said inhibitor is an AKT inhibitor only.

Furthermore, and also for the avoidance of doubt, whenever reference is made within this specification to a PI3K-α inhibitor, then an additional aspect is provided wherein the said inhibitor is 1-(4-(5-(5-amino-6-(5-tert-butyl-1,3,4-oxadiazol-2-yl)pyrazin-2-yl)-1-ethyl-1H-1,2,4-triazol-3-yl)piperidin-1-yl)-3-hydroxypropan-1-one (Compound A).

Furthermore, and for the avoidance of doubt, where reference is made within this specification to an AKT inhibitor, then an additional aspect is an inhibitor of an isoform of AKT selected from AKT1 and AKT2. In a further aspect, the inhibitor is a dual inhibitor of the AKT1/2 isoforms. In a still further aspect, the inhibitor is an inhibitor of isoform AKT1 only. In a further aspect, the inhibitor is an inhibitor of isoform AKT2 only.

Furthermore, and also for the avoidance of doubt, whenever reference is made within this specification to an AKT inhibitor, then an additional aspect is provided wherein the said inhibitor is 4-amino-N-[(1S)-1-(4-chlorophenyl)-3-hydroxy-propyl]-1-(7H-pyrrolo[2,3-d]pyrimidin-4-yl)piperidine-4-carboxamide (Compound B).

EXAMPLES

Abbreviations Used in Experimental Protocols

PIP2: PI(4,5)P2, phosphatidyl inositol 4,5-bisphosphate
s.c.: sub-cutaneously
ATP: Adenosine triphosphate
DMSO: Dimethyl sulphoxide
TRIS: Tris(Hydroxymethyl)aminomethane
CHAPS: 3-[(3-Cholamidopropyl)dimethylammonio]-1-propanesulfonate
DTT: Dithiothreitol
FBS: Foetal bovine serum
DMEM: Dulbecco's Modified Eagle Medium
EDTA: Ethylenediaminetetraacetic acid
EGTA: Ethylene glycol tetraacetic acid
BSA: Bovine Serum albumin
PBS: Phosphate buffered saline
HRP: Horseradish peroxidase
RPMI: Roswell Park Memorial Institute 1640 medium
4NQO: 4-Nitroquinoline N-oxide
EMEM: Eagle's Minimal Essential medium
$CO_2$: Carbon dioxide
PBST: Phosphate buffered saline/Tween
Ab: Antibody
MTS reagent: [3-(4,5-dimethylthiazol-2-yl)-5-(3-carboxymethoxyphenyl)-2-(4-sulfophenyl)-2H-tetrazolium, inner salt; MTS] and an electron coupling reagent (phenazine methosulfate) PMS.

Example 1: Analysis of Known Cell-Line Mutations for PIK3CA-MAP3K1 Double Mutant Profile In order to test the impact of MAP3K1 loss of function on the sensitivity of tumour cells to PI3K pathway inhibitors in a PIK3CA-mutant background, a comprehensive survey was carried out of the mutations identified in clinical samples and those present in cell lines available in the public domain. None of these cell lines had a genetic profile that matched the desired PIK3CA-MAP3K1 double mutant profile. The only cell lines found containing PIK3CA and MAP3K1 mutations also contained deletions in other genes which would potentially confuse the results and give rise to the potential for unwanted off-site effects (FIG. 1).

Example 2: Generation of Cell Lines Containing Both PIK3CA and MAP3K1 Mutations and Analysis of the Effect of MAP3K1 Loss of Expression on Activity of Inhibitors of Upstream Components of the PI3K Pathway In the absence of available cell-lines, cell line models were generated reproducing the PIK3CA mutations and MAP3K1 inactivation by two methods: first, by transient knock-down of the expression of MAP3K1 via siRNA transfection (FIG. 2A); and second, by permanently inducing insertions or deletions in the MAP3K1 gene using precise gene editing technology (FIG. 2B).

Independently of the approach, MAP3K1 inactivation in the context of PIK3CA mutant cell lines results in enhanced levels of pAKT (T308).

Method 1: Transient Knock-Down of the Expression of MAP3K1 Via siRNA Transfection MCF7 cells are derived from human breast cancer. They are characterised by expressing estrogen receptor (ER) and lack expression of HER2, a growth factor receptor of the EGFR family. For these reasons this cell line is considered an acceptable model for ER+/HER2− luminal breast cancer. A second cell line, T47D has similar characteristics. In addition, MCF7 and T47D cells carry a "hotspot" mutation in the PIK3CA gene and are amongst the most sensitive to both pathway inhibition and viability following treatment with PI3Kα isoform-selective compounds. MCF7 carries mutation c.1633G>A (p.E545K) and T47D carries mutation c.3140A>G (p.H1047R).

Several sources of commercially available siRNA duplexes (Sigma, Dharmacon and QIAGEN) were tested for efficient knock down of MAP3K1 by monitoring the expression of the full length protein by Western blotting. Following selection of the best performing siRNA duplexes, cells were treated with the PI3Kα-selective inhibitor Compound A with or without previous siRNA-mediated MAP3K1 knock-down. Due to the transient nature of the siRNA knock-down effect, cell viability assays were not feasible.

Protocol for RNA Interference (RNAi) and Plasmid Transfections.

Cells were transiently transfected using Lipofectamine RNAiMax (Invitrogen) and FuGENE HD (Roche). ON-TARGETplus MAP3K1 siRNA and scramble negative control purchased from Dharmacon were transfected to a final concentration of 40 nM. Transfections of plasmids were done using 10 ug DNA mixed with 15 ul of Fugene HD and incubated for 24 and 48 h.

Protocol for Measuring Phosphorylated AKT (T308) in MCF7, T47D Cells.

Low-passage MCF7 and T47D cells were obtained from AZ Cell Bank Collection and cultured as described previously (Avivar-Valderas et al., MCB, 31(17):3616-29, 2011). Wild-type and MCF10A-PI3K$\alpha^{H1047R}$ were provided by Horizon Discovery.

After culture, cells were lysed, and protein was analyzed by immunoblotting (IB) (Avivar-Valderas et al., MCB, 31(17):3616-29, 2011). Membranes were blotted using antibodies against MAP3K1 (Santa Cruz) phospho AKT (Thr308) (Cell Signaling Technology) and Vinculin (Sigma). Bound antibodies were detected with horseradish peroxidase (HRP)-conjugated secondary antibodies and chemiluminescence assays (Avivar-Valderas et al., MCB, 31(17):3616-29, 2011).

Method 2: Generation of Insertions or Deletions in the MAP3K1 Gene

In order to further test the effect of MAP3K1 inactivation and to mimic the mutations found in human breast tumours, precise gene editing technology was utilised at AstraZeneca Sweden to generate insertions or deletions in the MAP3K1 gene in order to inactivate its expression. Following transfection of MCF7 and MCF10A-PI3K$\alpha^{H1047R}$ with the desired constructs individual cells were selected by cell sorting and grown as clones. MCF7 mutant clones were MCF7-CR1 and MCF7-CR2. Mutant clones generated in MCF10A-PI3K$\alpha^{H1047R}$ cells were MCF10A-H1047R-CR1 and MCF10A-H1047R-CR2.

Protocol for Generation and Validation of MAP3K1 Mutant Clones.

gRNA were designed using procedures previously described (Doudna et al., Science 346, (6213):1258096, 2014; Ran et al., Cell 154, 1380-9, 2013; Tsai et al., Nature Biotechnology, 32, 569-576, 2014). gRNAs targeting MAP3K1 locus were subcloned in the gRNA-Cas9-GFP encoding vector and the sequence confirmed afterward. Cells were transiently transfected using FuGENE HD (Roche) and sorted for green fluorescence (GFP). Monoclonal cultures were selected by limiting dilution.

Genomic DNA was isolated from expanded clones using QIAGEN kit. PCR reactions to amplify targeted region were performed using Fusion Flash DNA polymerase (Fermentas). 10 μl of PCR products were directly denatured (95° C., 10 min), hybridized (−0.1° C. per 1 sec) and treated with Cel enzyme (Recombinetic). Digested products were analyzed using 10% Acrylamide gel electrophoresis.

Sanger sequencing of mutated genomic DNA: The same PCR products used for Cell assay were Topo-cloned (Life Technologies) and plasmid DNA of at least 5 individual clones per sample was isolated and sequenced using an M13 reverse primer.

Example 2A

The effect of MAP3K1 loss of expression on the pharmacological activity of Compound A using the cell-lines generated via siRNA transfection was examined by monitoring the level of inhibition of signalling readouts downstream of PI3Kalpha. A major readout of the pathway is the phosphorylation of AKT at Threonine 308. This phosphorylation is carried out by PDK1, itself activated by PI3K-generated PIP3 (phosphatidyl inositol 3,4,5-trisphosphate). Further pathway readouts are phosphorylation of PRAS40 (Proline-Rich AKT1 Substrate) at Thr246. This phosphorylation allows activation of the mTORC1 complex and activation of p70S6K resulting in enhanced phosphorylation of ribosomal protein S6. The impact of selective inhibition of PI3Kalpha by Compound A in MCF7 and T47D cells was monitored, which have been shown to be dependent on this isoform for pathway activation and survival (Fritsch et al., MCT, 10:1158/1535-7163, 2014). MCF7 cells have been shown to have a high basal level of activity of the PI3K pathway attributed to the activating hotspot E545K mutation.

Treatment with 250 nM Compound A for 24 hours led to profound reduction of phosphorylation of AKT on Thr308 in control cells previously transfected with a control siRNA duplex inactive on MAP3K1 mRNA (FIG. 2A). In contrast, siRNA knock-down of MAP3K1 led to a higher basal level of pAKT-Thr308 signal (~10-fold (MCF7) and 2.3~fold (T47D) increase (FIG. 2A).

Example 2B

Pathway activity was also assessed using the selected MAP3K1-deficient cell lines generated using precise gene-editing technology (MCF7 clones CR1.4 and CR2.5). As observed before using siRNA knock-down of MAP3K1, inactivation of the gene led to loss of expression of MAP3K1 mRNA and protein. As seen before, loss of MAP3K1 resulted in an increased basal level of pAKT on Thr308. Furthermore, inhibition of PI3K signalling using Compound A was less pronounced based on its effect on pAKT on Thr308 assessed by Western blotting (FIG. 2B).

Example 3: Proliferation Assays to Determine Growth Rate and Sensitivity to Compound a and Compound B of MAP3K1-Deficient Versus Parental Cell Lines Following the protocols and methods described in example 2 we compared the impact of MAP3K1 deletion on the sensitivity to Compound A with Compound B and the Genentech AKT inhibitor GDC-0068 using PIK3CA mutant cell lines.

Control MCF7 (parental) and MAP3K1-deficient (CR2.5) cell lines cultured in full growth media and treated with either Compound A, Compound B and GDC-0068 as described previously. Following overnight incubation, cell lysates are prepared and analysed by Western blotting using antibodies specific for phosphorylated proteins in the PI3K pathway (FIG. 3).

Figure 3:
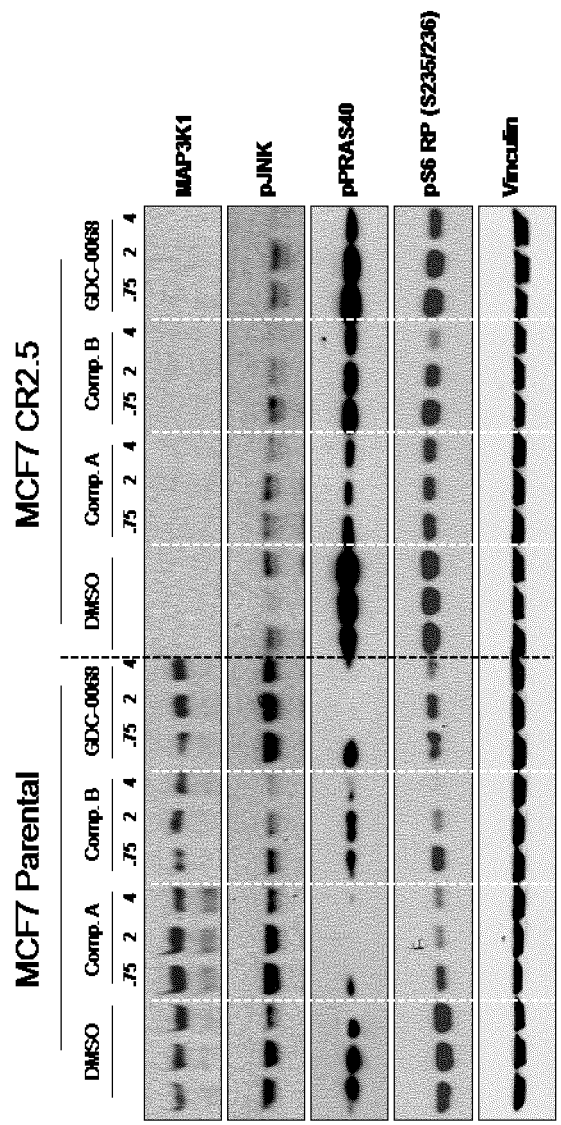
FIG. 3 shows the effects of treatment with increasing levels of Compound A Compound B (AKT inhibitor) and GDC-0068 (AKT inhibitor) on the levels of MAP3K1, pJNK, pPRAS40, pS6 RP (S235/236) and Vinculin in parental MCF7 cells (left panel) and MAK3K1-deficient MCF7 CR2.5 cells (right panel).

MAP3K1 and pJNK control blots show respectively that protein expression is efficiently disrupted via gene editing and that is reflected in functional inactivation of the pathway. pPRAS40 antibody was used as a readout of AKT activity and shows that MCF7 CR2.5 cell line has higher basal levels of pPRAS40 and furthermore it is resistant to Compound A, Compound B and GDC-0058 inhibition. pS6 RP antibody was used as a distal readout of PI3Kα activity and shows that whereas Compound A, Compound B and GDC-0068 can efficiently inhibit pS6 RP activity in parental MCF7 cells, MAP3K1-deficient cells (CR2.5) are resistant to all treatments (FIG. 3).

This data suggests that concomitant mutations of MAP3K1 and PIK3CA promotes resistance to PI3Kα pathway inhibitors and that this is not specific to AZ inhibitors (Compound A and Compound B) but is a general resistance phenomenon as observed also with the Genentech GDC-0068 AKT inhibitor.

Example 4: Proliferation Assays to Determine Growth Rate and Sensitivity to Compound a and Compound B of MAP3K1-Deficient Versus Parental Cell Lines Using the clones confirmed to have deleterious mutations in MAP3K1 and no expression of MAP3K1 protein, growth in monolayer were characterised and Incucyte technology used to measure cell proliferation on monolayer cultures in conventional growth media.
Protocol for Proliferation Assays Using IncuCyte Technology.

MCF7 and MCF10A cells were plated in 96 well plates at a density of 2000 cells per well in RPMI media containing 10% FBS or DMEM/F12 media containing 5% of HS (horse serum) respectively. After incubation at 37° C. for 16 hours, concentrations of Compound A, Compound B (30 µM to 117 nM) or AZD2014 (15 µM to 66 nM) were added to the assay plates. Plates were then placed in the IncuCyte and scheduled to be scanned every 6 h for 3 days. Relative percentage of confluence data was normalized to control DMSO treated cells and fitted to a nonlinear regression curve using PRISM (Graphpad).

Clones MCF7-CR1.4, MCF7-CR1.8 and MCF7-CR2.5 proliferated twice faster than parental MCF7 cells. Similarly, clones H1047R-CR2.3 and H1047R-CR2.7 proliferated faster than parental MCF10A$^{H1047R}$ cells (proliferation curves not shown).

Figure 4:
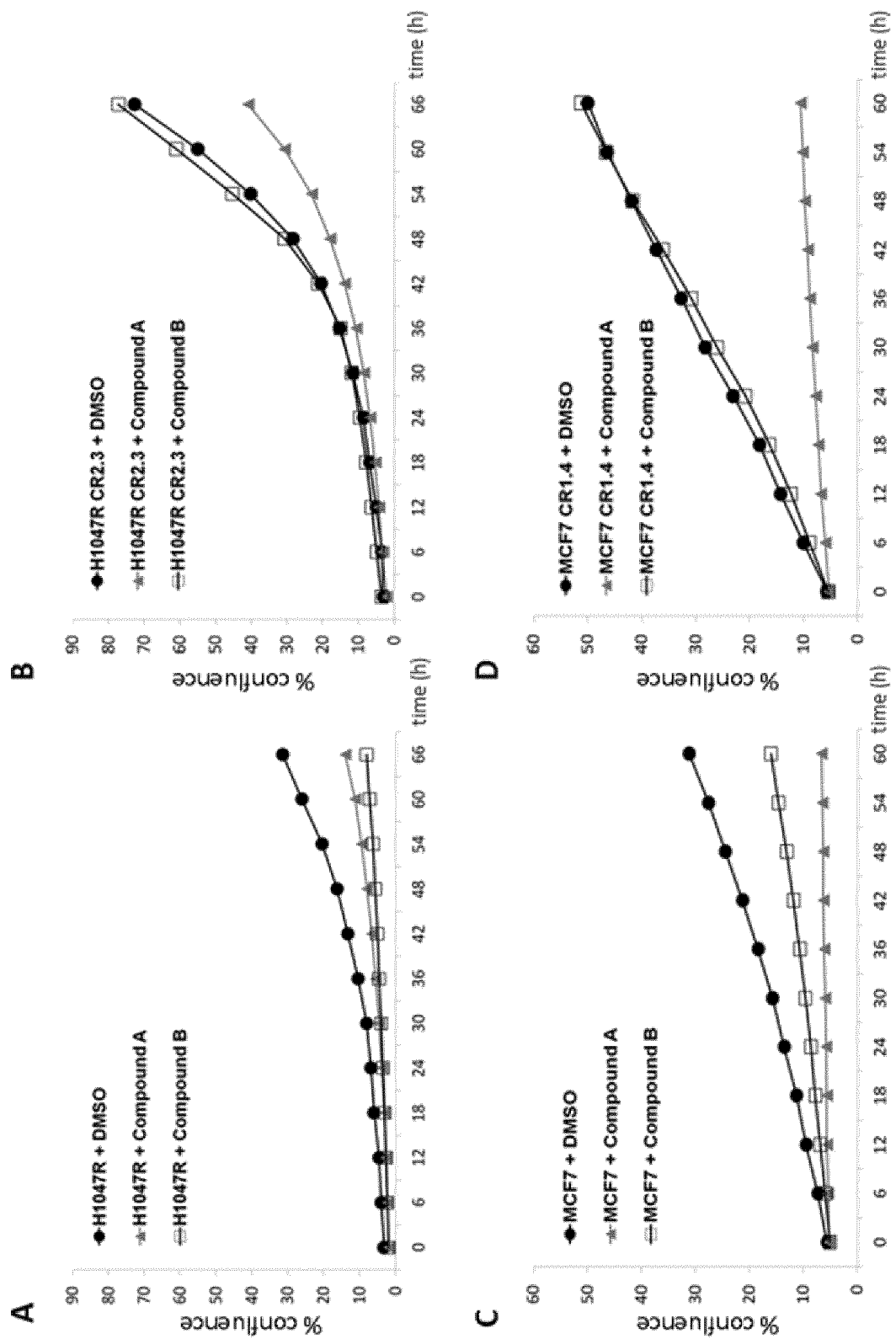
FIG. 4 shows the proliferation time-course of parental MCF10A-H1047R (A), MCF7 (C) and MAP3K1 mutant MCF10A-H1047R CR2.3 (B) and MCF7 CR1.4 cells following 500 nM treatment with Compound A and Compound B.
Figure 6:
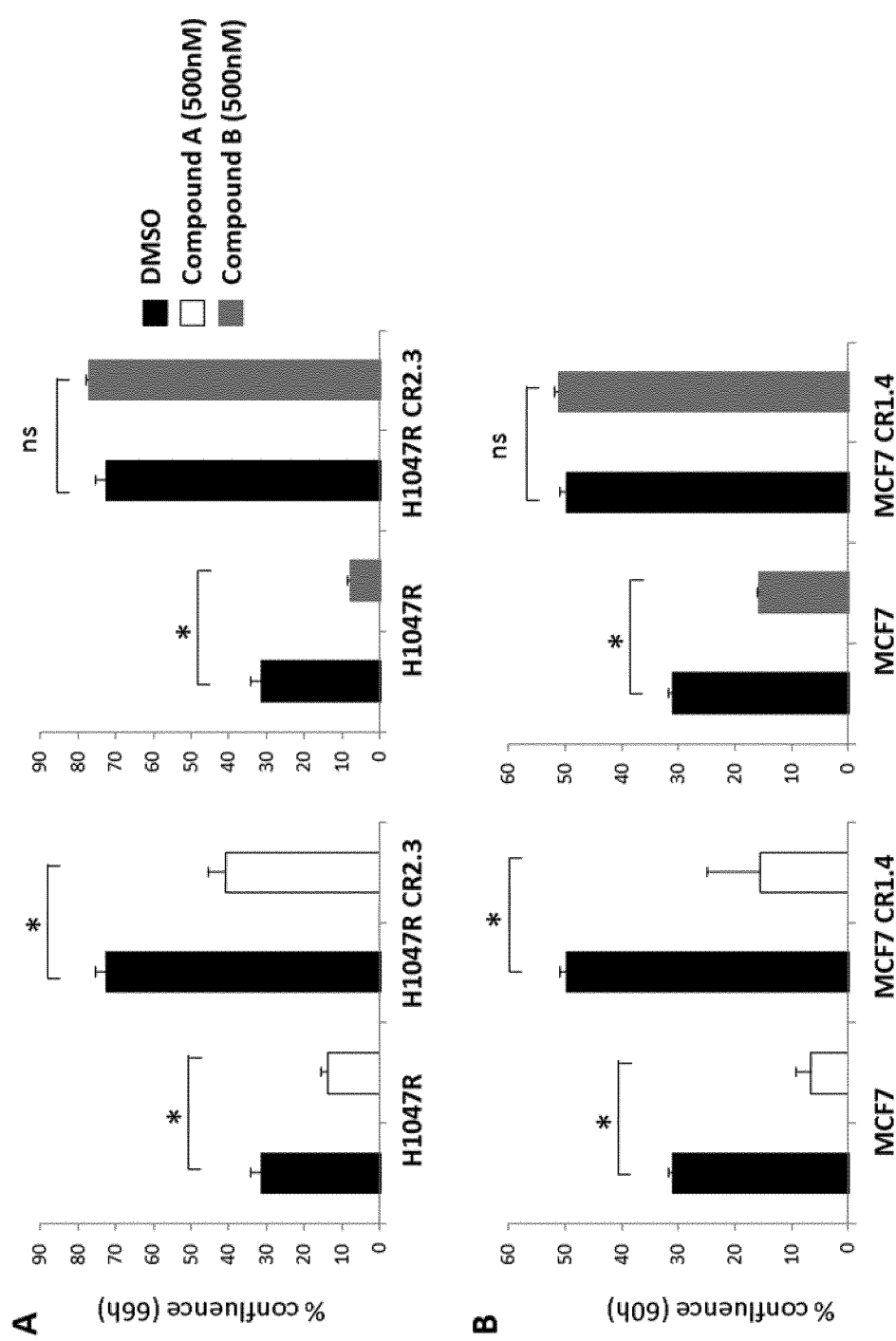
FIG. 6 shows the percentage of confluence of parental versus MAP3K-deficient cell lines following 500 nM Compound A, Compound B and DMSO treatment for 60 and 66 hours.

The effect of upstream PI3K pathway inhibitors Compound A (PI3Kalpha-selective, see WO2014/114928) and Compound B (AKT1/2 allosteric inhibitor, see WO2009/047563) and the downstream pathway inhibitor of the mTORC1/2 complex (AZD2014, see WO2008/023161) on proliferation of H1047R-CR2.3 and MCF7-CR1.4 was tested (FIGS. 4, 5 and 6). Although 500 nM Compound B was able to inhibit the proliferation of both MCF10A-H1047R parental cells and MCF7 parental cells, it had no effect on the growth of derived MAP3K1-mutant cell lines (FIG. 4 and FIG. 6). Relative to MCF10A-H1047R parental cells, the concentration of Compound B required for half the maximal effect on proliferation ($IC_{50}$) of clone H1047R-CR2.3 was estimated to have increased 10-fold (FIG. 5). In MCF7 cells, similar observations were made on proliferation. Although 500 nM Compound B was able to reduce growth of parental MCF7 cells, there was no effect of Compound B on the proliferation of MCF7-CR1.4 (FIG. 4C-D and FIG. 6B). In this case, the $IC_{50}$ for proliferation was increased 3-fold (FIG. 5).

We also tested the effect of Compound A on the proliferation of both sets of cell lines. We found that Compound A had a higher $IC_{50}$ for proliferation of clone H1047R-CR2.3 compared to the parental line MCF10A-H1047R line (FIG. 4A-B and FIG. 5). A similar effect was seen in MCF7-CR1.4 compared to parental MCF7 cells (FIG. 4C-D and FIG. 5).

In contrast, no significant change in the $IC_{50}$ of the mTORC1/2 inhibitor AZD2014 was seen when comparing parental and MAP3K1-mutant cell lines (FIG. 5). AZD2014 was as efficient in reducing proliferation in both parental and mutant backgrounds.

Taken together, these data suggest that MAP3K1 genetic inactivation in the background of PIK3CA mutation reduces the inhibition of proliferation of cancer cells by Compound A and Compound B, two inhibitors of upstream components of the PI3K pathway. In contrast, inhibition of proliferation by an inhibitor of a downstream component, mTORC1/2, is not affected by MAP3K1 inactivation.

Example 5: Analysis of Effect of MAP3K1 Activation or Depletion on Inhibitors of the PI3K Pathway in 3D Growth Cultures It is known that cancer cells grown in culture can show very different sensitivity to inhibitors when cultured in three-dimensional format (3D). Epithelial cells form well-organized polarized glandular structures under the influence of extracellular matrix (ECM). Attachment to ECM is required for the control of normal epithelial cell proliferation, differentiation, and survival. 3D matrigel partially recapitulate in vivo human tumour context by providing to epithelial cells proper integrine anchorage. This is essential for expression on receptors and survival proteins that might determine cell fate decisions and drug sensitivity. Finally, studies of lumen formation in 3D culture and of ductal elongation during mammary gland development both support a key role for anoikis in luminal clearance (Debnath et al., Nature Reviews Cancer, 5:675-688, 2005)). Since MAP3K1 has been reported to be activated in stress response (including anoikis) via activation of the JNK pathway, 3D growth cultures should show a clearer effect of MAP3K1 inactivation or depletion on cell growth and survival and its impact on sensitivity to inhibitors of the PI3K pathway.
Protocol for 3D-Matrigel Culture.

For 3D cultures, cells were plated in commercially available growth factor-reduced Matrigel (Mgel) (BD Biosciences, San Diego, Calif.) and grown (Avivar-Valderas et al., MCB, 31(17):3616-29, 2011). Prior to fixation for IF analysis, acini were treated with 500 nM Compound B every 3 days until the endpoint (day 15). 3D-Matrigel MCF10A acinar structures were fixed at day 15 and processed for size measurement and IF microscopy analysis (Avivar-Valderas et al., MCB, 31(17):3616-29, 2011)

For anoikis assays, cells were collected (Avivar-Valderas et al., MCB, 31(17):3616-29, 2011). After quantification, $5.10^5$/ml of cells were kept in ultra-low-attachment plates (Corning) with the appropriate growth medium at the indicated time and/or treated with Compound B.

Figure 7:
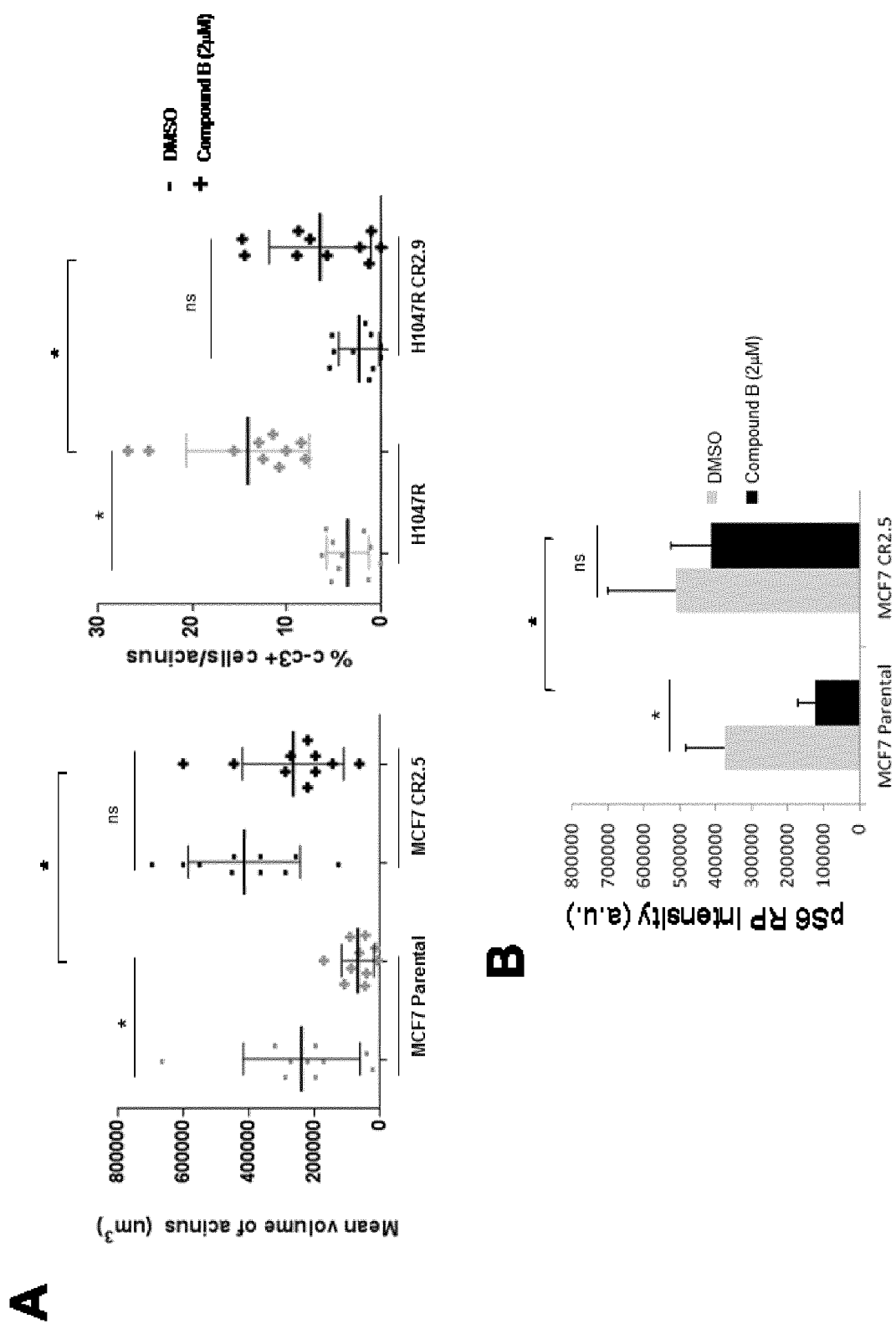
FIG. 7A shows the effect of MAP3K1 depletion in volume (left graph) and apoptosis (right graph) in 3D-Matrigel acinar structures. MCF7 parental (grey) and MCF7 CR2.5 (black) acini and MCF10A-H1047R parental (grey) and MCF10A-H1047R CR2.9 (black) acini were treated with DMSO (−) or Compound B (+) for 15 days.
FIG. 7B shows quantification of pS6 mean intensity of outer layer cells of MCF7 parental versus MCF7 CR2.5 acini in the absence (grey) or presence (black) of 2 µM Compound B.

After 15 days of morphogenesis, MAP3K1-inhibition via gene editing (MCF7 CR2.) did not substantially increase the number of acini, however it significantly increased acinus volume when compared with control (parental MCF7) acini (FIG. 7A, left panel). This might be explained by an increase of cell proliferation or/and reduction of cell death (anoikis in ECM-deprived cells). To test the latter, staining with caspase 3 (anoikis readout) and confocal equatorial sections to analyse lumen formation (main compartment in which anoikis takes place) were carried out.

Further, Compound B treatment significantly reduced acini volume in control cultures (MCF7 parental) whereas this effect was partially reverted in MAP3K1-deficient acini (FIG. 7A, left panel). Accordingly, whereas Compound B induced a significant increase in the number of positive cleave caspase 3 events in MCF10A-H1047R control acini, this increase was not significant in MAP3K1-deficient MCF10A-H1047R acini (FIG. 7A, right panel).

These data suggest that MAP3K1 depletion reduces cell death and attenuates induction of apoptosis mediated by upstream inhibitors of the PI3K pathway.

To confirm previous 2D in vitro data suggesting that MAP3K1 inhibition reduces sensitivity to Compound B (FIG. 3), we stained 3D-acini with the PI3Kα pathway marker pS6 RP. ECM-attached cells (located in the outer rim) were positive for pS6 RP in parental acini. As predicted, the number of pS6 RP positive cells was greater in MCF7-CR2.5 (FIG. 7B, grey bars). Finally, whereas Compound B treatment strongly reduced the number of positive pS6 RP cells in parental acini this effect was reverted in MCF7 CR2.5 acini (FIG. 7B, black bars).

Figure 8:
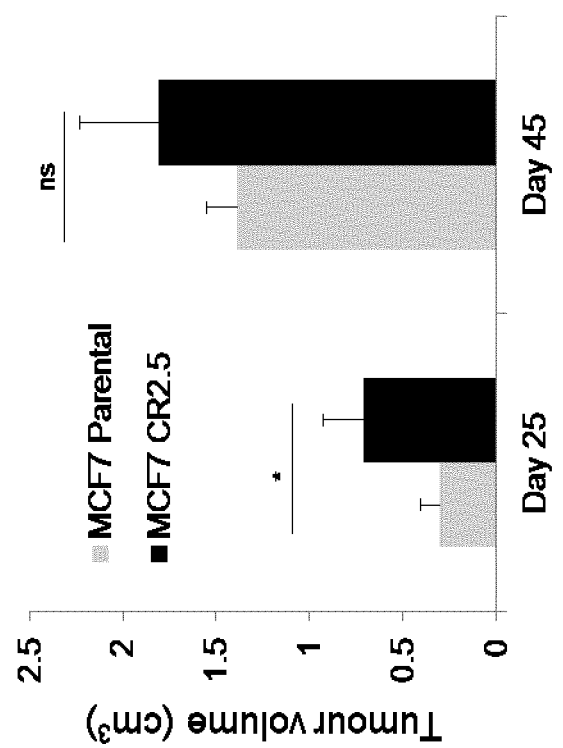
FIG. 8 shows the tumour volume of MCF7 parental versus MCF7 CR2.5 xenograft implants at two time-points (25 and 45 days).

Example 6: In Vivo Xenograft Analysis to Compare Growth Rate of MAP3K-Deficient Versus Parental Control Cell Lines We have used 3D MCF7 and MCF10A-H1047R cultures assays to model early carcinogenic events. Using this approach we have observed than MAP3K1 depletion promotes tumour growth volume and prevent Compound B-induced apoptosis. Although these represent a more physiological approach than 2D in vitro assays, we have validated this using in vivo assays. FIG. 8 shows the difference of tumour volume of MCF7 parental versus MCF7 CR2.5 at 25 and 45 days after post implantation. Whereas at day 45 the difference is not significant at day 25 MAP3K1-deficient cells have larger tumours than parental and suggests that CR2.5 clone takes more efficiently and grows faster than parental control cells.

Method 3: In Vivo Studies.

Parental MCF7 and mutant MAP3K1 MCF7 C2.5 cells were grown in complete growth medium as described previously. Once reached a 80% confluence cultures were trypsinized, counted and implanted as described previously (Kevin Hudson et al. MCT, 10.1158/1535-7163.MCT-15-0687). In summary, $5 \times 10^6$ cells were implanted subcutaneously in the flank of SCID mice with 0.50 mg/21 d oestrogen pellet implants. Tumours were measured twice weekly once visible and animals weighed twice weekly unless weight loss is observed. When tumours reached ~1.6 cm$^3$ or when tumour/animal condition dictates the experiment was terminated.

The examples described herein illustrate a link between the genetic status of upstream components of the PI3K pathway and the status of the MAP3K1/MAP2K4 genes. In particular, mutations in the MAP3K1 or MAP2K4 genes is shown to lead to a reduction in the effect of inhibitors of upstream components of the PI3K pathway, such as PI3K-α inhibitors and AKT inhibitors. In contrast, no effect is seen with inhibitors of downstream components of the PI3K pathway, such as mTOR. It is therefore advantageous for patients who are being considered for treatment with an inhibitor of an upstream component of the PI3K pathway to have the genetic status of their MAP3K1 and MAP2K4 genes determined. Patients who have wild-type MAP3K1 and MAP2K4 genes would be preferentially selected for treatment.

SEQUENCE LISTING (20 sequences)

SEQ ID NO: 1 - DNA, 33396 bp, Homo sapiens
cgggcggggcgggcagagccgggagcccacccccagcgctcacctccgccgccccgagctcctctccggtcgccgctcgcgcgcgcgccctccccagggcggccctggcgcgcgtggagctgcgggcagcgcgccccggcggggagggcgcggggacggcgagggcgccgggcggggcgcgctccaacttggctggcccagcgccgcccgccgctcgccccgccccagagagagcgaaactcggggcgggggccggagggggcgggccgagcgacttcccggagcggcggaaccgctgaggtcaccctcgcccccccttccctgtccgccccacccggccgggccccgcgcgcagccagcaggggcgctggggtgtgaggggggtttagggcactgcgcgggggcagggggtctctcgcgatacttggcgctttggcctgggtcccccacctcccaacctttcccggcatggggtccttactgcgccagtctgcaaaaggaacccttccgagggtccgcttgtatcccagcccgcgttgggcagtcacccgagggtaaacccgggaccctggcctcccgccacctcgcagggcgccggccttgggatggcgtaggggttgcgtggattgggggtcgttaattttgcaaagatgacacctccttcttccttgaaagcctctttttgaatttaattcagctgggaccctcttccaaacattcaagcaggatgtcgatcctagagtccagaacggggacttccaccctctccacagaccccagcccagcgtctatgggggacccagcgcagagaggcacggaaaacgggcacctcccagcagacatggtggcacggggggacaaacgccataacagagacagtcggaagccctccagagcccagggtaggcaggaacgtgttcaaagaggaggagactccggacaggggctggcatgggagtgggggtagggaggagtgggggaaagtgttctagggcaaagaagcattgagaagatgtgagggggacgcctggttgtgggagagggaatcgccagagaagtagagagtgtgtttggcggggttagggtccctcccaggcagatggagccttttcccaggggcacaacctgggctgcccttgactgagcaggtttgaaggtactctagaccaccggatcatcttcacaacagtcccattaactagacgctcttattttcatacctttttggtgagagagtttaggtaaggtacccagagccatgtatcaggcagtaagtcactgaaccacgatttgaattcagccggtctcattcttctctgccttggagtccgggaaatggagaatgtagtggaggagtcaccccagtcaaggccaagcagtggggtgggggtggtgctggaagaggggctggatcacaaaggacaggacccggccaggtatgtgtgtgcaggaggagtggagcccacagtgggatctgaagtctgggaaggaaggcctcgttgttatactaaaatatcattccttgtttcaccggatggactgcatctttatttcctaaacctggcaactgcagcttggacccctggaatgacactgcacttacagccactgagactagcttagggacggcagaggcctggctcccactgccgccggccatccaccctaaggaccccttcctgaggaaggtcaactcccctctctccacgcatttaaataatcatctgccttgccccagccaccagcaggaatagctgaattcaagtaagttaagggtgaactcagatgtgactgctcccttcctgccctgcctggatcacagccctgccccggcccctcccaaccttgagcacgaccaaacctttaacctctttgaacctcagtaatcctcatctgcaaaatgggagtcagagtgcatcccggggtcttcgtgaacattaacgacagggcctggcactcagcaagctctcaggctctggaatgttcttccccaaagaacccttcactggtttctcttcatccctgtctctgctgaaagtccactccttagtcagggtggccattcctgcccaccttcgctaagttccctcgcagtcccttctgctgcataccctcctttccagcccattccgggtgtcctgtgattgtgggatattccagcaccttctgaaagggaaggggctgtttggtcacttggtgcttaaaagttggcaggacgcaagtgggtgttcagtaaatgtttgttgagtgaatgtgtgacggttgcttctgtgagtgattacgatggtcccaccatccctaatcctgactcctctgtggcaacattccagccctgcctgcccacacccccagcccctgaaccttcagagcaagtaggggtggcctgccacactggggctctgggcaacaggctgacagctccccactgcaggctgggagcaagcaccctagcctgccctgcctggctggcgggacagagagagcctggacacttaatgggggttgtggtacacagggagggtcaggatgctgccttcaggagcctagggtaggacctggaaggagggcccagctaggaatgggctagatgaaggggaggggacagtgggagagaagctccttatccctctcaggtcgggatgtctgggttcaagtccctcctgccccacaccgatcagggaaggggggctgttccaggcagagaccgcccagagttggtgctgggatcctggccagcctgtagtcctcagagcccctgtgactggctgggtctcaagtgcaggaatgacaggacaccgtcacacagccactgtcgcggcggtggtggttcaggcagaacctctgcagactcaggcggccatctggcctgggagctgccctgaggccccgccctgcagctgctgctgggacctacacagcccagggccctcgagtcctgcccccggccagcagctgcagaaggtgacagggcaggaggcccctgagctctgggaggaggcagccgtcgggcccttccctggtgcagcagtttttgtcggaaacatctggccacagagcacctcagcagtcccagcagcagccgtggggctgggttctctcctgaccattctgtctggggtgggagggggtgttcttgaagagaggactctgctttccctctgggacgctggaggagagggagatggccctgcccactgggagatccccgtcttgggggagggcagttcatgccaaggtgaagacaggactggagtgtggggcccacagtgggttgcaggcaccagcagatgccagggcaccaggctgggaagactgggaggcctccttggagacagccagtgcaaaataagcaagaggtccaaccacttcaagaacagcccgcaatgtcactgcctcttccatgagagggtgccctgctccctcccacatccccaagcctcggccacttgctggccttgtctcatggccctcttaccctctgcttcctccctgaattccttcctccatccttgcatggcagagcccaggatggtggacagataccaggaactcttcctcggggagcagtgggcaggtgggacagtcccagagggagccccaggtggctcatggtgcaggtttgctgggtgagagacagacaccagacgcccaggctctgggggcaacccttgtgtcaggtatcccacccaagcggcgcagaccactgggcctctgacttggccccctggaggtgggcccttcctggggttacaaagtctgagctgggagggagcagaggtgctcaggcgagaggcaggaatggggagtcccctgtctgaggagcgagtgccctcatgcagggggagagagtccttctcttggtcagccccaagaggcagggatgaagcccgagttttggctgcagactctgtcctgagcactgggccgaacctgctgcctctgtctgcatctcctcccaccccctcccctgctgccagctgaactcactctggctgaaaataaaaatgctcccccaaccccaatacttagcagcctcaggaaggtaactcacaagagtctgtctttcacaaaagggttattatcaactgtgggcctctggaatgggggaggggcagttgtcggaggaacttctggctaggaaggggtcggggtggcagtcacctgcactctcctgtgagtgtccaggagaaaggggtctgtgtcccacttactcattccatacccgggccatctgcctcccagtggacttcggactgggtgtccgggctgaccaagtccacccagcagggagggctctgggctgtcagctgtcacagcccaccctagacaccgctcctcctctgtctggtgtctgctcccagctcaaggtgggagccaggcaaggtgtgcccctcttctcccactccccagcaaagtcccccttttgtgagtgtagctgccagtacctaggtgaatggttgactcccctcggagccttcctgctccttggaggcccacctccaactgacctcctgtcctggcatcctcccgcacttcccccagaggcacaaggtcttgggattgggccttttaggtcactcttggccgccccctccacgccccccagagtggggcagcctgaaagtcaacctaagccacccccgccccgcgcgcggaggcagaagtccgggattcgtccctgacctgtctcgggccccttctgctagggtcacggcagagcgagcccagaagcgccgggtcactttacagacggggaaactgaggccagagagggcgtggccccgggacgggctggctggtggccgggctccgttagcggcccagcccaggccccaggtcgtcgggagctgcccctcagcccggccgcgcgctccccgagcgcgctccgccctcgccgccggccgcgcggtggggacgccccgggcggcggaggcggatgtgggcgggcggctccgggcgcggggcgggcgcggggcggggagagggcgggccggcggcggcggcaggaccgagcgcggcaggcggctggcccagcgcagccagcgcggcccgaaggacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggtgagtccccgcccgccgtggccgcccgggcctggatttcctccccgcgggccgggccgctttgttcgcggccggtcgggccggggcgcgagccgcggcgccgccagaatggaggagcgggagcaggaagtggccgagcgggcctgggcggggagggcgcggggcgcgcgggcccggccaagggagggcggccccacgccgggcgccgggggtgcaggctgccggccccagcctccctcatgaccttggggaggccgctccgccgggcgaggccgggacccgagagaagggacgccgccgggcctggagctggggctcggggtgcccctgcgggccgtggggctccccgggcgctgggccagcgaggcagccggcggaggtgccccggggttggagaaagactcgccgcggccggccttcaagtttgtgggagggccccggaaggagacttcgtttcccacggacgaaaagttgtacgtggtggcggggtacccaggctagccacaaaggactgtgaccctcctgggccccggaactgcttcctgtcttgggtgggccctggaggtcctgcccgcccatcccagaggccaaggcttggagggcagctggggcttgccccttagattgagtatcctggggcgctagcgagcttggtcctgtcgggacggcctctgagtgctgccttggtcagcgggtgagcttgggcccctgctctgcagccagaggccgccccacattcactcctgggtctctcggccttgctccaggtggccacttcttgactgctttgagtccctcatccgagcgaagggcggacggagtccgttggtgggggtccggttgcctctcccgggagctgtgtagacttctcatacaccagggttctggaggcagatggaggagccctttcgaaaacagagtatttttttttaagttgtgacttaataatagtagcaagaatatgtgcttatggtaaaggcaggcggcaggtacggaggctgtgggaagtcggggtccctccgcccccacaggcagccctgtgctggcctggtgtatacgtttctgtgcagacgtacaccaccctgtgtgagcacagatgtatttttacacatggctctggacagctgtctgactctgtcagcagcaggccttggaggggctcaggcccgtgtgggggtggggggacatccagaggtctttgagtccagccctctgcctccaggccacgcccactcagtgtcgtcagagccccctgtgcctgaggcgtgcgcggctcggagccctgccctcggagtcctgcggtgccttcctcgagtctggcctgctttccatcctgctaagtacttggggcatttccctctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcaggttagggaggctgggaaggccttttggggatgggggtgatttgtccaacggctgggggaggtgggaatggggaggtgagcaaggcagcagctctcagggcctggctgttgcgggtggtggtggcaggggctggaggctctaagcctagaataaggagaggcccaggtccagggaactgtgttcaattacatggatttgacacttggcagccctgagtgttttggggagagggaaggcaggcgggcagatgggggtcagagagcttagagggatggcagcccacctgggaaggcaggtgcgggtggagcccccaggcacgtgcagtgggtctctggctcacccagggcgaggagctgcccttagccaggcgtggcctcacattcagcttcctttgcttctcccagaggctgtggccaggccagctgggctcggggagcgccagcctgagaggagcgcgtgagcgtcgcgggagcctcgggcaccatgagcgacgtggctattgtgaaggagggttggctgcacaaacgaggttagtacccgctgccagggctgggcctggggagggagagatgggggtagtagccccagggtctgtgagtgcctgtgccctgctgggtgggaggggctgcctcccctggggctcctgggctggcctagggtgagtgtcctgggccccatgtcttcccatggcatggagggcacggcctcggggaggccaggaggatgaggccctgtgcagggccggccatctgagtggcttcctggtgtgggccctggcaggcgggggagctgctgccagcctctctcctggctttcctggaaggcagcgaggacactgggctgttccagggtctggcacgctggcggcccagggcactgcccaagggctcctgagggcagggcagggctgcttggcttggcctggtgcctgcttcaggcctgagctttgggggtggggggaatccgtaccgcctgggcacagggcatgtttgccttggagctgcagagctggctgagccaagtcccccagcccctgtgtccccctcctcactcatttggccttgcagcctatggaggaggtgctgcccgaggggcctggccagcagctgggtgggatgggagctggggacatagccccaccccttccaaccctgtgcaggcccttctgcctcacccaccctccgttgctcagcggggtgcggtggagtctgggtggctgttttgctcctctgtcctgctagggtgggcttcctgttcaggtccaggtcctctggccaagtcactctcttctgccccaggcggaatcggtccgccctctcctgacttctttttccagacttgttccctcctaagttctagtgatctcatgccagcagccccccggctttacgtacaccctctagcagatgggtttcacatctggtagtggggagaccccaaacacagctggagcagacagggaggtgtggcaaaagtaggtgtcacaagatggggcattgtgggatgtataggagctcacagaagagcaggcctaaggagccacaggagcctgggggtggggtgaaggagtgaccgagatgagatgctgggggaatcaggggtgtggctggctgtgtgtttggagtgtttgagtgggcagctaccagtgatggcacgcggggcctcgagatgaagacaaggaggctgcagacgcctgtggtccttggggagcttctggctctgcttccccccaaggcctcctgccgcatcctgccttctccatcccctccccgtgtgctgtcccctgcttgttccccaggagtcctgccacctgtgcctggaggtcctctcctcacctcacagccctctttggtgtcagggaccccctgccccgaccctggccctgttcctctctgtgtcacatagtctgctgcctggggccgctgcttctttatccttggcaaatgtgtgtttgttgatagactgttggatctcgggctgacccaggagatgccagggccttgactgcccaggggcccaggccccagttactggggcacccatcagccagctgggcctaggcaggagtgctcccccgaggccaggtgattttcaggctgctgctgatgtcgtgccttcaggaggggcctggcagggacaggacatcaggcccagtggggcgtccagagagctgagtttgaaccctggttagccactctatcgccatgaccctttccaagagcaaggtcattgagctccttgggcctcagtttccccatctacaccagggagcggtggtgggagagagacctggtggagtggagaatggcttgtgggcggccctgagttggggtccggccagcctcagcagcctctgggctctgtcatctggcccctagcctcaggccaggagagagggtcctgtacctctacccccggctcttcctcctccatccccagtgtagtgggcgctgaggatgggaggtggcgtggatatgacatatgcccttggcaggcatagcccctcttgttgccgagagcaggtggcgtccacccgcatggccggccgctccttgcggaggaaagcctgtcctccggggcctgccgcatttcgccactcccgtccctggggtcccctgtgtgtcttgcagatgtgctgtgccaccctcctggcagggccagccccacccgcaacactggttagaggtactagctgccttcctgtccctagcagggctgtgctgggctgaccccacccgtgcttcacagtgctcaggcctggctgggggtggggagggagggagggacgcagtgactgtcctccaggcccggccgcagccccttgcagacgccctgttccactcccccccagccttgctcctgcaggtcagggtgcttgtctcagaggctggcccgcacctgtcccctttgccgggactccccacgaccgtggcctggggcactttggttctcagctgaatccccaggtgacagtcccaccacggctacttgggctggccacacgtggcgtgatggtgccttcaggggtgatgtggtcattgagatgagaggggacgggtatgccctgtgtgtgaggggtggggtggcagtgtctgcaggctccttctcctgctccttgggaggtgagcgtcatctctgggaagtggcccaggctgctttctgttgttctgatgtgtgtgctctgagtcagaggagcttcagggacagaagggaccgggcatggggacacaggagttccggctgcaggcctgtgtggacctgtggctggacccaggcgaggcctctgggtctgcacatctaacagggagatggttcctggagggtgagcttaggctgttaagggcaggagctagtgaggaggctggtggggcctatagggacagggggccagatgtcccctcctgtttcggctgtctcactggataagcagcccagctcagctctggccattggtggtctggtgggctcagtgttgctcagacgtttgcattttcaaagatttgttctgttgtgtgaagtctcctgatttttgaaggctgacaattttaaaaaatcaatcctgggccagggcgcaggtctggctgaactcggcctccagcctgcagttttccttcctttgatagctccgtgccaggctttggccagaggctgtgtggctcttttgaggtactttccccaaacagcttgctcaccttgcccgcttgccccagtactcctggggccgtgcaccagcctggctgcagcctagccccgtggagagctgccctggtgcagccccggcctggagcctgtttttgtccactcgcggctgtcttcctgagcgtccccccgtccacatggctggaccaagtgggtcaggagagggccgaggcgggtggccgggatgctgggacccaggatgaggtgctctgggctctcgagaaagggctgggcctaggccaggagtgggtgccggccgcaggggcaccacctggactccctcaggctggtcgctgtccgagaggggccggggaagagctgcaggcctggctgccttcggcaggctgtgacccagcaggccaaggccgagtgggcgggggtcgagggaagctgcctggggcgcgtgggttacgcggcagacgctcctgagtgtgtgggcagcgtgtccaagccacggatctgggtgcctggccgggcccgggtgacacgggaccgtgtgtccatgcggctcacggagggtccagtctccggacatctgagtccttgccatgccctaccccgggcccatgcctggcatagaccccccagtccaggcctcagggcagccccctcaccactcctgctgagttagccccaggcgtcccggtggggagtatggaggctggtctctgaccccaagcaggtgcctaggctgggcctccttcccaccccctctccccgccttgaagtcctggcactggctgtccctgcgggggggcactgaggcagggagagagtggttcctaccccagtgtgttacttcgctttggtgagcgacatagaacctcactgcatccccagctgctgctcagccatccagctggtcctggggtccctgcgtgaggtgggggacctcagagggtacaggccactccccttcatcctggaggaggccttggctttgctgagtaaacacccttgagaagaggtctgtgggggactctgagcccactccagagagcagctgctgcggagggccccgcagggctaattgtttgtgtgcagatggaggctgctcattaccccgccaggatgaggggcccagcaggaccctgagggagggagcccgcagactctcccctcagcctgtgggaacctttgggctccaggccagggctgcctgtgcctcctgggcctcagtttttcccaggctgtcaggtgagggtcaaccccaggctgcgtctaggtggcttcagtgtgagacccgcgggccctgggctggttagtgccaagctctgcctcccctgggggagcgttgagggtctggaacggcccccgtgggcaggccagggacagagatggggaggcaagtgtgctggctcctggtgggagggctgggcagagagtgggggtcccaacagccctgggcctacccgggagaggggcaggaggcacaggctggtggaggtcatggcatggctgtggtggaggccgccagcatcagggaggttcctgttttgggagcttgttgagttctcacttcaaaaacaacaaaagaggaagccgaggtggccttgagtgggggtgaggggtcactgctggccccagccctggaccttagcccccacgcctggtggctcctgagtggacagctcttcttcctgtgtgtttcttggtcactggccctctctgggcagggatgccctgtggggggctggactccgggaagggaaactgaggcccaggagagtggacagaatgtgggtggaatgattcctgtgctggggcctagacccccgtacaccttccactctcaggagaagcctggccgggttgcatcaggccgggttcctagaagtcctgcacgaggctgagcggagggaactggcgcggcccccgctggcgtcccctctgcctgggcacacccggcccggcttggggccagcaccctgccctcgggccctcccatagctgagactggtggctgtggctgtggctctgggcctgctccccaggccaccctgggtgggcagctgcctgctgcttctgtctgcttggaccattgtgcctagtcccatggcctcaggagaaggttcccccagcccagcgctggggccccgggcaggttggcagagggccctggggctccaggccaggatggggctgttaggcgaaccctaggccccttacttcctcatctccaacgggagttcccttccctgccatgccgcctttaggtgtgttttccttgaaccttaaggaatgataggtttggatttcagaaacgttggaattgagggggttgggagttcatgggtgactctgctgccaatgttgcgggctttggggtgggatccttggggcgctgtgtttgggctcacacaccccccaggcgggcccggtgactgcagaccccacccataccctgtaacctggcgggcccacctgcccaggccctcagctggttgtccagctcaggggtggagacaccccctgggcaggcctggcggggaggtggctgctccctgggcctggagaatgcagagaggcccttcggctggccagggtctggctggcctccccacagactggggccaggggcacagcagccaggtgtagggcgcggagacgctgagctgcacaagcttggtgaggtgtggggtgaggccacgggggtcagggccacaatgtcccagcaggccgggggatcagaaggagcaccctccacagctggccgtgctctgggggccctcctgccccaggcgtggctccaagttggggcagaaacaagatggtggggagatggaaggcccctctgtggcgggtgcttcccatggtcggtgtggaggacgaggtccctactgcctggttccagttcccccagcaatgcagggcacttttcctggggtgtcagggattgagaggccagcactggagcccttcaaccgccaggggccctgcccaagagagacgggaggagggaggggctgtgggcatggctgcgtgcccccggccgagccccggaaggagcctgtgcccgtgcccacttcctttcccgagggcagtgtctacacgtgggacactgtggccagccctccctcgcagcaggcactgtgtgctgtccccatgcccagcttcctcccacgcagggagcgagggtgagggccctgggaacccactgggtggagggcacttggcaaagcctgctgcaagttatggggagagtgggcgggggcagagtaggaggcgccagggaggggctgcagcctcatctgcaggggtcctgagtaggcagggtgggccatgacatgggtggggcttgtttggggcagaccaaaaatgaggtgggggacagggacagggacagggtcttgggatgtgctgggctctgcgatggatgggtgtgtggcaggtggggtgcctttgccggcccgaggggtgggtgacgggcagtgcctgtgggggaggacatccaggcccaggtggtctgtcaggggcagcaccagggaggcccagtaccccacccagtagagccccaggagaatggaaagctgagacccaggtgcttccctggagtggcaggaagagaggccccagcgcctccggctgtgcctcagcgaggtggacggggtcatggtggtgccgcctgcccgcaccatgttcctcccggggtgtgtgtgtcgggctgaggcctgctccatggtggagcggaaggaggtgaagaatttgcagtttgtgtcaagttacaacccctgccttggcggcaggacctggggtctctctggtcatgatctgcctctgagggtcacctcccctaagtctccgttttcccagggagctgatgggcatgatgagccctgcccgccctgcctgcctggtgggctttctgggagagcagaatgggtcctgggctgggcgaggcccaggcaggtggagcgccagtcctctgcctggcgggaacagacacctctccttgtgcagactggccacttgtgccccctcagaagggcttgtgccgggaggagcagtggatgtatttcacccacagacctgggggctccagccaagtggggtcagctggcctccgttgtgtggcccctcccctgcccccaccccagcctggttgtttacagggttcgagggctgctggtaaaggggtgtgtactcccgggcccgggcagaggcctggcaggccgggcccttcgcggtgagctgtgcggtctcctggcaggcggggagggtgggttgcgggcccctcatgggctgccgtcagcggagccgtctgctcaatgtgctggagaaggtaaatgggcccccggcagctgtcggggcgatggatgtgtcggcagtggggaccacggtggccgctgtcagctggcgcccgctcccagggcctgctgggctcactttgctgtggagaagcagctcggtgccgcctggcaccctgccagccgctgccaccaccgtctctgcgaagtgtttatccagcagtttcctgagaactggggactttgagagaatgttcagggagctgaggacgtggtggcctaggggggctgacacacctggtggctcaggaggtggtcagtcccgggacgtggagggccaccagctggccctcaggggcccacccagtcctgcccatggcgcgtgggtcctggcccccatgtctaagtgggtgccgctttggggggcctgacccacagtgtggcctgggacacgtgtgtgaggcgtggagagggtgggctgcctgtgactgtccatgtggtccccgtggtggtggtggggtgggttgggggaggccaggcaggagcagcttcctctcagaaccccggtatttggtccaggaggacttctgggaaggaaccctctttccctgggggtgctccagccccttcctggggatgagcggggttggggatggaaggtcactcctgccggagggccacccgggacatcgggatgccagagggaccagggctggggttgtgtggggcccaggaggtgcaggaggagtcgagggagcctggtctccgctgtccccccgggcagggacaggagtctggccaactgcctaccccccaccgagggcagccacctcccatgcctggagccctgggccatggatgtgctggctggtggggagggttacgggtttcatcaggcacaggagcccctgcccttgtggcttcacaggacctggtcttggataggtgcagtgtcacagggttaagggtcagggtggctcccacctggcccagggctggccttgagagaaccctgaagggtgggaccggagctgctgcctcccactgcccagggggccagcaggagggtgagactggaactgctgcttccccgctgccgagggaaccggccatggggcaggagggtgggaccggagctgctgcttcccccttgcccaggggaccagccatggggcaggaaggtgggaccagtccccagtgccgtcctccactcggccccccactcaggtcttctggcagtggtgtggggtcccccatccggacttgctgacatttctgaaggggcacctagccgtcttccctgccagaccctgaggcccaggccggggttgcactgggaccctgcctgctccaggtcccgggtctgaaacatgtgcagcgggtggggacttgggggttcttgagcccagcatgggggtgtgagagttagggactgaagaggccccctgggcctgaatgctgggcggtctccattgcccttgggagtggctgctggcaggagatgactctggctgtgtgtggggtggggcgtgccctggcctccccatttgttgcctgcctgtacccgtctggagtgagggcctggcgtggcaacctgggggtctgtgcccactctgtgtttggtgccctcagctgtgcaggcaggtgggtggggtggtgttgggggggtgactggggtggggtggggggatgccagctggctgatggtggggagatggaaggcccctctgtggcgggtgcttcccatggtcggtgtggaggacgaggtccctactgcctggttccagttcccccagcaatgcagggcacttttcctggggtgtcagggattgagaggccactcttcaagtggactgtactcctgcctcgagtggggggcatctgaggaccacaacagggtggggaactcaagttaagtcctggatgacaggttccagttcccctggggaccctcaggatagtgaaggagaagactccatgtgggttggtctctttgtgtgaggggtctgggagggcagccctggctgatgtgtctgtgctcccaccctcctgagggacccggagtaggcaggtgcaggcctgcaggcgtcctgtggccatgaggacagtgatgctgggccccgggtggctgtctcctccacctgccccgtcctgtgtcaccccagtcctggatcagggagtagtggggccctgccgcatctgctgtcggggctggccgcccacccagcatcctgtctgggctgaactcgttaagatgcgcgccacggccctggctgcagctggcacccccccaagtgatcctctagctgaccctctaggcgagagatgaagaaagagaactgtgtgtctctggaccccttaccccgggtccctggggatcctgctcctcccctggaggggtctgtgtgctgggctgggatgccgaagacaaaggccacgtgaggccccttcactcacacccgtctcctggggtaggccctgatcgccgtctgttccctgggtctgtggggccaggcgaggggaaggcactgaaagcccagggcccatttgggcctctgcccatcccaggactccccaggaatgctcggggctgggcacctgtcctctcccaccccccacgcctggtaagcgccgcccctgggcctgcccctcccgcacccccagatccagctcccagaaccccccagatgcagctcacagaacctggggctgggcttgtggcagcagggtcaggggcaaggctggggttgggcacgggagctgcgtgctcgggggcagcacggggccatgctgggcacggtgggggctggcagcagttggtggataagatgggtttcaggggtgccgggcctgggcgctcatcagtcttcccgctcagttagcgtcccggggagtggcagctggcaggatgggaggcactccatcaggggccgacagctccagactggcatgcaggcgggtgggcgtgagcagcggggtggcccaggatgggggacgggtggggtgggctgcatgcagccccctgagcctgctctgctctcactgagcgcccctgcctgcccgctgcacctgcaggggccctgtggctgggggaggggacgtgggaggcggggtggagctgcgtggcacgtatgtgcgtgtatgtgcacactcgggggtgtgcgagatcccaggtcagggacaggagccggcacccaagggtggcaggaccacgcctgctcggcagcccactggcaggggcatggagggcttgcggagtgggtggggtctcctgatgagtgctcttgggcacaggggcagattctgggccctggatcatcctccctgcaactgggtgttggccgtcctccagaggtgtcaggcagctatgagtgggctgtggctgtccccttcctggtccaccccagacctgacaacagcctcttcccacactcaggccctgctgggtggggtgtccccaccctccaccagcatccccccagcagccctggcttgggcagagagagggctggtcttgtggagaccacgccccgtggtgctggtgggaagggcattgggcagctggggccggggtaggagggagaggtcacctggccggggggtggccatgtgtcgagccttggtggctcacctctattaaagaactcccccgtggctccctggaaagtagaatgcctgctgggatgcccatgacccatgtcctctgagctcccctggggctgctgccctgctgggacttccctgtgcaccagggagggctggacgcgtctgggctcaccacgaagacccagcaggactgggtggtgggtggtctggtgatgggacaattgcttgtcccccacatccctccaggtgtccctgtctggggctcagtgtggcatgaaaacccaggccccagagctcagggaccccaaccccttaccctggccccctccctaacccctgcccagtgacccctcagatgaagcagttgcctaattagtaagttccctgttgttcaaactccttgcttggcaaaatgtaagtggaacatttttttccgagtgtcagtatgaaaaatggtacttgctgggctatcaccgaggacagctgctctgattctgaagtgtgaacgcctgcgtacggctgatgctgcaaaacttgagggagaatgttcccgtgtacctgaatgacccacgggtgggacgcggcagggccgacggcggcagggcctgagtgtgggtctcagcctggggacttggcaccctctgtgccctggggcccctgcccagctggctgggccacctccgtgtctggcttcatcggcagtccccaagacggtgctccaggcccctagacagggagtgcgatcccacggcagtgggcagtcctgtcccgcgagcccggccctcagtctgagtggtgctgacctctaactgtggacgccatgctccatcctcctggtgggtggcggcggggcggggggggcggccatgctgggcagcccacacaagccactgtcacctgctgtcgccacctggccgaccctggttgattggggaatgctgtcagccccgcagcccctgtggccatagctggggcccgagctgctgctggtgcctgctggggactggctggtttagggctgcctcctccaggaaggctgtgcagactggcccagacctcttcccagcctcctgtccatggtactccatcccctgcgtccagctggcccagcccgttttcagacacagctcggggtggctcttctgagaggggcgctgtggtggggcgagtctgccttcccgttgacccagggccgtttctgtcgctggccctaagaaacagctcccgtaccgcgcctgccccctgggactcaggcatcccaggcacatctgtcctggcacacccagttcctgcctggctgcctggcgagggtctgacgggtagagtgtgcgtggctctcaccacccgcacgtctgtaggggagtacatcaagacctggcggccacgctacttcctcctcaagaatgatggcaccttcattggctacaaggagcggccgcaggatgtggaccaacgtgaggctcccctcaacaacttctctgtggcgcgtaagtatccccttggcctctcgggattcagatttggggggttggctggagccctctttgcccaccaggccccacgatgggggtcccctggagcctccaagtcctgggctggcaagcaacaagcactggctgggtgggggtctctgggccgagtcccgaggctggctgggcaggggtctccgggctgagtcccaaagctgaggctggctgggtgggagtctccaggctgagtcctaaggccgaggctggctgggcaggggtctctggtccaagtcccgaggccgaggctggctgggcaggggtctccgagctgagtcctgaggctggctgggcgggggtctctggtccgagtcccgaggccgaggctggctgggccggggtctctgggctgagtcccgaggccgaggccggctgggcaggggtttctgggcagagtcctgaggccgaggctggctgggcgggggtctctgggccgagtcccaaggctggctgaccctggagcagttccctggtgcccatgctctggaagctggagggtccggacaagtggcagcagagcccagtctcagggtggacagctgccccgggggcccctcctccaagggggttagatagagcccatcagggcctctccttgggaaaccccttgggtgagggggcaagagtccattggggtctccagctctgaagcctccatcactcgaggaagagctcgtgcctctccctgcacaggctctcagcctccagaccccatggcagagcctttgcttcccctctgtgaggctgcctccttgcccatggaggggcaggtgcagaaaggccagcgggggaccttggccggagcatcccacagagatgagagacatgtgacgctccctgctccgccctgctgtggctttattccttacctgtagcgggggcaggtgcgaccctacccatgtcagacgggaaccctggcatggagacccaggcgccctgctaggtgggaggctggggacacgtgggcctcccagcatggtccccattttctgtgtccctgtcctggagcccagctctgcctgtggcagccagagacacgggttgggcatgcaggtgtgactgagtggctaattagggcccagttgtgggccatctgtatgtggcagggctgggtaactgcaggcctctgggatctgtctcaggcaggtctgtggtgcagagcgaggtgcccaccaggggctggccttaggttccatccccatgtgctgcatcggcccctcccctccaagtagctctgccctcctttctttgaggcctgcggtcctccgactcccttgaacttgctggacccccaggttctggtccagggtctgggaggaggttaaatgcagggaatccgtccccaggctgggcagggaaggactcccacccttggtgcctgcacgtataaggggaggtggggtcagtctggcaccctggctgctaggtggtctgtggccagcaaaccgtgccctgaagcttctagttgggaggggcagaggccttgccctgcaaagccccaggctgaggggctggggttggggtggggtttaccaggacctggttcctgtaagccgaggtctccttccctggctcttccagcctcaagccagcagtagcagggcagcctgatagagtagggcaccccaggggtgaggggagaccaggaaggcagacacccctgtctcctgacagcctcgtaaccatgcaggagactcactgtgacttgtcccacaccctccccagtgtctcctcggttggggctgggggcttcagggatcagggagaggctgggtgccagcagcgtgcctggtggcacctgggacagggccttgctgggggtgggtgctgtgggtgtgctcgccaggccgaggcattgggaaggaacgaggtggggagctctctggagaggcacacgggtgggtaccagctggaggtgttgcctgagcagctggcaaggctggggccttcagattaggccataggtgagtggcctggagcgcctggccaaggagcagagctgggcaggggccaggggctgtgctgggcctctgtccggggcttttctccggggaacggttccggggcagtgggctcgagactctggccctggggattgcatactggggcagatcggaccatccaggagcgagtgggaggtgggtgtgccggggcttcacaccggtttccacttctctggcctgtgttgacacaggccaccctccccaccaggctggtcccgagccccctcctggcccccaggcctggaagacagcttccttgctgcctggccaggcccccttgtggttgccagggcctcgatgctggaatgtcagaggccccccactggcccctcagcctcctcctgctttgcacaggctgggccagagcctgccacggagccccagcggctacacactccactcactcacacctctcagggccccgcacgttcccacagccctcagggtgtacgtgctgtaggtgtggctgtgccccaggtatgtgttccccaggtgtgcttgtgccccaggtgtggctgtgccccaggtgtgcgtgtgccccaggtgttcgtgtgccccagatgtggctaggtgtctagatgtgttctagatgtctgtgtattccagtgtggctgtgtcccaggtgtgcgtgtgccccaggtgtgtgcctcaggtgtgcgtgtgccccaggtgtggctttgcctccagtgtgtgtgtgccccagatgtatgtgtgccccaggtgtggctgtgccccaggtgtgcctgtgccccaggtgtggctgtgccccaggtgtgcctgtgccccaggtgtgggtgtgccccaggtgtgggtgtgctccaggtggctgtatttcccaggtactcagggtgaggttgggaaaaaagcaggacatttctacactaggtgggacaagcaggtttctggggtgcccccctcatgccagcccctctgtgggatctccatacccctcatcctctgaggcctggcgcacggcggggctcagagactgaaggaaggactgtaggagtggacgatggtgggggtttgacctgacgccgggccagatgccctgtgtggctgcctcagcctggagtagagtgtctgagctggaacaggggtcctagccccactctgtgaggcgagaaactgaggcttggagagaggaagagatggggcttcccaggacctggtgggtggtatgcaaggggagctggctggtgcagcgggggctgtggtgagggccctgggaggggcagggggatgcacgcagacagaggctctgcctgcccgcagagtgccagctgatgaagacggagcggccccggcccaacaccttcatcatccgctgcctgcagtggaccactgtcatcgaacgcaccttccatgtggagactcctgaggagcggtacgtgggctgtggcggccaggccaggcacttgggcagccccagcgcttaggagggacacggggatggcggggtgctggcacctctgcctgtagccatcctcactccccagtgctcccaggccctcctcagagcccagtttggaaactggcccagtcctgcctgtggggtttgggtggggaaactgaggctggagataaaaactggctagggaccgggtgcagtggctcacgtctataatctcggcactttgggaggccgaggtgcgcagatcacttgagaccaggagtttgagactagcctgccaacatggtgaaacccccgtctctactaaaaatataaaacttagctgggtgtggtggtgcacacctgtaatcccggctacttgggaggctgaggcacaagaatcgcttgaacccgagaggcagaggctgcaggagccgagattttaccactgcactccagccagggcgatagagcaagactccgtctcaaaaaaagaaaaacccggtggagagggccagtcctccttggggggcggagtcctgcttgggaggcggagtcctgcttggggggggcggagtcctgctggggggcggagtcctgctgggggttggagtccggttgtggggacagagtcctgctggggggctaagcctgggtgtcccccacgtccaagagggcttcgtgaccctgagtgtatgtggccagaccaggtcaagtggtggcctcctcagggctgtctctgggaaccccgacagctgtggaaccacgcttgtgaggctggcgggtgggtgaaagacgtggggtggagctcctgatctggtacaggcctgcagcctcacctgacctcctgcagggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtggtgaggcctgtccccacttctgcctgtgcctggggctgccttggactgtggagggctgggtgggtcatggggtcccagctcggcccaggagacactcagcactccacggcatctccacctaggccggttttccatgtagggcgcagctgcttcccaggtgggtcctcttccccatgtcagaggaaaactggggttgctgagccctgccaggcttgggcaatgttaccccacccttccctgaaccccatgctctgagctggggccgcagccatgtgttccctgtaagcctggactccccgctgagcccagtaggccaccaggtgtgaagtggacgcctctcctggctctgcctccgactctggggcccctcatgccaccccacgcatgccgaccagctgggcactgttggcagcgccgcttgctgaccctggtgcctgcccatagaccatgaacgagtttgagtacctgaagctgctgggcaagggcactttcggcaaggtgatcctggtgaaggagaaggccacaggccgctactacgccatgaagatcctcaagaaggaagtcatcgtggccaaggtggggccggggcggtggggcagggtggagatgagggtgcggggtggcagctcacccagccctgctttacaggacgaggtggcccacacactcaccgagaaccgcgtcctgcagaactccaggcaccccttcctcacagtgagtgggagcccagatggggctgaagggctggggccaggtagcgactcctggggctgtctctaggggacgatgtcctgtcttcttgggcacgtgagggctttacacaccgtggactccgccgctggtgagacaggcctgccctggagggtcaggctgtggaggtgcccagtgtgggctaggggctgtgctcgctgctcccgtgtgcgggcaggtgggtggggcaggtggccctggtcttccttgcactctgccgaggctccaggaggccccagctccccatgccctgcagccctgcctgccaggcttttgttgaggcccgggctctgtcctgcagaacctgttctggggacttggcccaggaggtatttactgtgaagggggccagggtccagccacttggttagttccaggtcactgtgtttggggacgattctcctgcagatggggcctttgctttaaaagcacagtcgcctgtggtggaaggcgggagggtgggtctcgcctgggagggtgtgtcctccctttgcgaaggccctggtgctgggagcactgtcccctgctgaggtcccaactcaccctggaggacctgagcccaggccaccttgctcacctttcaaacactccttggcacctcaggggctgccggggcccagcctgatggtggcgtggcatgaggcagtgtggtgtggggcagtgtggtgtggggcagcgtggcatgggggcagtgtgatgtgggggtgtatggtgtggggcagtgtgatggggtgtgtggtgtggggcagtgtggtatcgggcggtgtggtatcaggcagcgtggtgtcgggcagtgtggtgtggggctacgggcggtgtggtatcaggcgacgtggtatcaagcagcgtggtgtcgggcagcgtggtgcggggctgccgtcctgcctgtggggccgcagttccagctccccttccttgcaggccctgaagtactctttccagacccacgaccgcctctgctttgtcatggagtacgccaacgggggcgaggtaggggctggggctgcgggggatggacttcgcggcctgtgggccgcccatggtggggccggtccttcccggagcctcggctactctccatggcaccagacggtgctccctgctgggtgggtggtgtgatgcctgcccaggcagctgcctgctgtggggtgacttgttcctgctgagttagggcttctgagactttccaggcccccgtgccctctggtggctggtcccttccctgtgcaatgccgagacccggtctgagaaaccccagccctgcaggccatgggggcagaggcccgagccacggctgtgcctcaggttgcgcctcccgcagctgttcttccacctgtcccgggagcgtgtgttctccgaggaccgggcccgcttctatggcgctgagattgtgtcagccctggactacctgcactcggagaagaacgtggtgtaccgggacctcaaggtgcgctggcgggcaggcaggggggcagggccctgggggcctggcggcactgacctgaggccacctttcccctagctggagaacctcatgctggacaaggacgggcacattaagatcacagacttcgggctgtgcaaggaggggatcaaggacggtgccaccatgaagaccttttgcggcacacctgagtacctggcccccgaggtgtgcgccccacctgcgtgcatacgcgttgctgcgtccccacgtcctgagcacacgcaatgctgtgtcctctctgtgccccaagcacgtcacacctcccccggcagtgtcccggacaccccttgatgccgagtcctgcccatctgccacccgtgcaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggtgagggccgcccatcccagctacaggctacacctccatcccctcatccccaggctgcacctgcccctgcgccaggcggtcctggcacctcccagactacactgatagccaaagcttgatgtccttggccagggctgatctccaaagcctcaggcccaagcagagtggcgggcaggccggggtcagttgggcctctgtccccaaccctgcagcctgcacccacccactcaggaagcccctgccctgccgtgagctctgtggtgctttgctacccacagctgctcagggacgctgcaccaccggctcccctccctggccccggaacgtcctgtctggcgggccctacatcacaggaggaaggggcctgaacccagggcctgggcaggtggcggtaccgacactgtggccttgtttcctgcctgcaggcttggcgggggctccgaggacgccaaggagatcatgcagcatcgcttctttgccggtatcgtgtggcagcacgtgtacgagaagaaggtgcggctgctccccgcatattcacgcgcacgcatgctccccacatatccacactcacgcatgcacgtggcacgctcgccagatttcccacacactcgccctcacctcaggagcctgctgcagtcctggtacaaggagggccttgctgcaccaacctcagcgcctggtgctcagaggctctggcactgccgggttccaccaggaaactggcctggtcctcatttcctcctcccctcggaggtgtgtcacactctgagtttcctcctcccctcggaggtgtgtcacactctgagtgccagccttggggttcccttccctgacgctgtgcagtgaaggctggctggtggtggaccaggggtgctgccccttggcctccacgagttcctcctgtttgacctcaatcccttctgccgcaaggagagcccagccctatttctggctgtgcagggacagggacagcacctacttttctggcacatgggggagtccgccctggagggaggcagctctttctgcatgagtcgccatcctgggtgctcatctttcagggaccctaggagccctggccatcaccccagctgatggggtctgccagctgggttcggaagcctgcactctgagatgctgggtgccctgtcaccaggtgtgcttctgccccgttcccagcctgcccctcccctgaatgcctgtcctaggctgtgtgcagctggtcgggctgggcagccctgggacccagctgggcacctgttctcccattaacacagggtgccctggtcctggtccccgttcctgccttgaggcctgccaccctcctgccctgccctccaagggtatggggggcctgggcagtgctcaacctctgcccagccttgaccagagaccttgctaattgacaatggacaatgctggtgcccagcccagactctggggtggggcagtgcttgagggggtccttgactgtgggacctgaggggctctctggcagctcctcacgtgtgcacatcaccttatagtcacccttcatcctgggtcattgagagtcctgtctgcagccagatgccagcaggctgtggtcctgtagtccctgagccatggaggcagggtgggctcatcctgtgcaccttgttccacagtctccctctttcccaatttacaagaagaccaataagaaaaataagaaaacaagaaagaaaaaggaaaaataaagttatcacctcctggtagcagggagggtctctcagagctgggctgcactacctcctgtcgcctgctggggctgctgtgagggcagctttgcgtctcagctgttgagggttgtctccgtgctcctgcacccctcatgtccctccctcccagagctgcctctgtggggggctggtggcttgctgctctctgacatcagtcctgcctggagaccccttggagatccaggtgctttgaaggtcttgagcacacttgagggtgtgctgggagtggggagcgaagctcatgactgtcccgtctgcccacctctgcagctcagcccacccttcaagccccaggtcacgtcggagactgacaccaggtattttgatgaggagttcacggcccagatgatcaccatcacaccacctgaccaaggtgaggggccactgcctgcccccgcccactcccttttctctccacactcagagaggcctgcagtgttcagcttttttggcttcagatgttttaaaatctaaatatttaaaaaggttccttttggagagtgccaatgatcagggtgggaggcagtgctctgagggcccaggtccctgtgtcaatctgtggggccctgtctcagtttcctggcagtatggcagcgtgctggccgtgctttaagaggttggcttcctactggagctgtgggtgggtggaggtggcagggaggtggggcaccggggtctgagctgtctacacccacagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaatttttggctcactttgctgggtggaagagtgggtggccagggagggagtggggagtcctgggagggaagcagcatcctcagagcagctggtcctccccagctcctcctggtgggcaccgccaccccaacaggtttggggacaggctgtgtggtgggccgaggcgggagtatacaggcctgttcccaggggcagcctcccatggaaggtgttccacccccatctccagaggcctggcctgaggggagatgggaggccctggctggccctgcccccgttgggatccacctcttcttcccttgaccccacccagcttcaccccagccatgaaggagaccattggaccacgtggccatctgccccccagccccaggtgctgttcccctgggtagggcagtgaatgagacagaccaccaggaaggacagatagggcagggcccagagttggggccaaggtcatggcctgggccacggtggaagtaaggctgggaggcctgagtggcctgttcgaagctggacagagcgggaggaggggctgcaggcggtgggaggaggggctgcagggggcgggaggggacaggctggggcccaggttaccccagagcactacatcgagctctgagccggaacagcctgcagaatgtgccggtgctgccacctggtggacgcctgccggaaccgcgccctgagccaggagaggagtccactgccgagcaactgacagcgggttggcgaccaggttccgggtggttgggtgaccagcacgagccaggggcctggagcttcagcttcctcatctctcaaatggactccccgtaggtgtggatggttgcagagtcaggcccctggcgatggcaattggcccctctctaaggcattcccaggggtgcgtggctgccctcacttccactggagggggtgccccatagggagcacaggctggcgaggatgttctgggtctgtgggagccaagaacagccacatctggagcagcccgaagctctcctctgggtgatcccttattgcttcagttctaacaggccgcaaaactgataccgcttttcgggaaatacacgaaacatgacacagtaaatgatgttccgagggtgagaggcatctggatttcagatctatcaataatgtgactcttagaaaccaaaaaatacagcaatgcccttccaatatccacaaactttgagcaaagcattgctgaaagtaaccaaggtatggaaatggtcaggcagacgcagcatctcccagacagcccggctgagaagcatgggctgcttctcccagcacggccccctctgacaatataggattgccttagggccatttcttaccttttttatggtagagatagggtctcgctatgttgttcaggccggtcttgaactccgggcctcaagtgatcctcctgccttgtcctcccaaaacgttgggattataaggtgtgagccaccacacctggcctcttagggatagttctatagtccagagagagagaggcttcaacgtcattggcattaatacagacatgaccctgtgttatgtccccgttacaagtggctgaggacctaacaaaatgaacgcagaaatggagaccctctgagaatttcccgaccctcctagcagccccagacagaaccatctacagcaggaggcagcatcccaggagtggggtggagggtgtcagtgaggggtgagatgtgcaaggagatgcacatctcagagaggaaactccaggaggtgcaggtgcccttgcaaggggcagtccagtcctggccagcgaggccagagcgggtggagagggccaggatcctgcagccccaacagggcctgccgaacagcgagggctgtctggagaggttgtaacaggaatacgccaaccaagaggaagctctccttcctgtgtcagaggtaccccgaaggaaacaatgcataaagtgtccatttccaagacaaagtgcctaaaatcagcttaggtcagcaaactacggaa

SEQ ID NO: 2 - DNA, 62042 bp, Homo sapiens
tttgtagattctggctcgggaatcaaatacatgattttggcatttctttataatgtgggaaactcttttaaatattttatttatttatttatttatttatttatttattttttgagctagagtctcgctctgtcacccaggctggagtgcagtggcacagtctcggctcactgcaacctctgcctcctgggttcaagtgattctcatgcctccgcctcccagtagctgggattacaggtgcctgccacctcccgggctaatttttgtatttttagtagagacggggtttcgccatgttggccaggctggtctctaactcctggcctcaagtgatcctcctgcctcggcctcccaaagtgctgggattacaggtgtgagacactgtgtccagcctaatattttaaataaaaaataaaaatggggccgggtacggtggctcacgcctataatcccagcactttgggaggctgaggtgggcggatcacgaggtcaggagattgagaccatcctggctaacatggtgaaaccttgtctctactaaaaatacaaaaatcagccgggcatggttgtgggtgccagtaatcccagctactcgggaggctgaggcagaagaatcacttgaacccaggaggtggaggttgcagtgagccgagatcgcaccactgcactccagcctggtgactgagagagactccatctcaaaaaaaaaaattattttgtgactagtccccacagcttgtccagttgccatcgataaggagactcctctgtgagaagccttggaatggactcctgggcctgatttctactccctgggcacagaagggggctttgaggagatgtcctctccaacccttggggcaagatccctcatcgttttcttttttctgaatcaagagacctttgaacagctttcaataagttaccggccccctctacccagcaaagtgcatgtgcagtccatacttatagttatggggagagagtttatagactagattaagatggaagaaaatggggtgaggttgtagggaattttcttctggttcacactttttttctttcttttttttttttttttgagatagagttttgctcttgttgacaaggctggagtgcaatggtgccacctccgctcactgcaacctccacctcccgggttcaaggaattctcctgcctcagtctcccaagtggctgggattataggcgcctgccaccacgcccggctaaatttttgtatttttagtagaaatggggtctcaccatgttggccaggctgttctcgaactcctgacctcaggtgatccacctgcctctgcctcccaaagtgctgggattacaggtgtgagccaccatgcccagtcgcctcgatcgatcacccttgatgctgaaatggaaagggtctcgctgtgttgccctgccacaagattcaaagtggccctcaagtttcacccttgatgctgaaaatagagaaagagtctcgctatgttgcccaggatggcctttgaggccccccaaagataactaagccatttgcagaagtaacatagggcacaaaagtagggccaatacttttccattttctagcatgagttgagttaagagcacaggctctggtatcaaactgtctgggttcaaatactgtctttgtccttaacttgtcctgggaactcaagcaaggcccttaatgtgctgttacatttaacctccagggttactgtgtagatagcaacaggatagcatcagtgggagtgtgtttacacagaacttggcctgtaacaattgctaaataaattatattattactgtcttaatagaataaagaaaggcaagctcagagaagtgaagtgactttgacaaggacacagaaaagatacgattagaacctgggcctactcatcatcaatgctaaaaagtgttgtttacctcctagactaatgttttacaaactacaaggcacaaccagaaaatcagttcagcagggttgcggaattgaaataaatagtatattaagggctgggcgtggtggctcatgtctgtaatcccagcactttgagaggccaaggtgggcagatcacctgaggtcaggagttcgagaccagcctgaccaacatggagaaacaccatctctactaaaaatacaaaattagccaggcgtggtggtgcatgcctgtaataccagctacttgggaggctgaggcaggagaatcgcttgaacccaggaggcggaggttgtggtgagccgagatcgtgctattgtactccagcctgggcaacaagaacaaaactcagactcaaaaataaataaataaataaaaatacaaaaattagccaggtgtggtggtgcacgcctgtaatccctctactcaggaggctgaggcaggagaatcacttgaacctaggaggcggaggtttcagtgagccgagatggcggatggcaccactgcactccagcctgggagacagagtgagactgtgtcaaaaaaaaaaaaaaaaaaaaagaatattaggccaagtgcggtggctcacatctctaatcccagttctttgggaggctaaggtgggtggatcgcctcagctcaggagtctgagaccagtctgggcaacatggcgaaactccgtctctaccaaaaatacaaaaaaattagctgggcatagtggcgcacatctgtggtcccagtacttgggaggccgaagtgggaggatcgcttgagcatgggaggtgtcggttgcagtgaactgagattgtgccactgcatttcaacctcggtgacggagggggtgaaaccctgtctcaaaaaaacaataaaaaaccaaaaccagaaagagccgggtgcagtggctcacacctgttatcccggcactttgggaggccaaggcaggtggatcacgaggtcaagagatggagactatcctggccaacatggtgaaaccccctctctactaaaaatacaaaaaaattagctgggcgtgttggcgcgtgcctgtaatcccagctactcaggaggccgaggcaggagaatcgcttgaacctgggaggcagagggcagaggttgcagtgagccaagatctcgccactgcactccagcctggcgatgcagtgagtctcaaaaaaaaaaaaaaaaaaaaagagaaagccactgcccttgactaccagtgctgcaaggagtttatacacaagcacatgggtggtttcagtgagatctcagtgtgtcataattaagtgccctaggaggggctaggattcaagttggcccaggggagacttagacgtaggggaatggcctgtgagctgttcagtgtggacaggagtgaagagggttggtcacagtaaccttgagtctagattagggcagaagggctaatgcttgaaacaaacattctgcaagagcccactctgggcaatgttggatacacactgatctctgagacagtcttggtctcttcctttactgtgtttcctgtgcagtgggggaaacagacctgtcaccagacagtaatagatgaaaatggttagggctgtgaagggggaggcattggtcagagttattaacaccgactgatggggaagaccgggaattaggaataccaagcagcaagttccaagctagaaaccaaataagaaagggctagttccagcattaggtttacgtctcagaaaacgaaagccgaaccctcagcaggatttgcctgaaacactctcacagactgaggtggacccaggattcaactctcagtcaggcatttttctcacttaccaatgcatacaattgccaagttatatggcatactggaacccaaattcaggaggcagcacaatcccctatgagagaggaggggctgggagccagatgtctcacagctgtccagtatactagctaatatacggattaggatctgtgcaaagctcttttcttgcagggtcattttttttcttttttctttcttttcttttttttttttttttttgagacggagacttgcactgtcgcccgggccggagtgcaatggcatgatctcggctcactgaaacctctgcctcccgggttcacgcgattctcctgcctcaagcctcccaagtagttgggattacaggcacacaccgacatgcccggcttttttttttttttttgtattttgagtagagacggggtttcactatgttggccaggctgtctcgaactcctgacctcatgatccgtctgccttggcctccccaagtgctaggattacaggagtgagccaccgcgcccggccgcagggtgattttaaggcctttatgggcccaagttgcattataaaatgttatatcccagattcactggaatatgtacgatgagagcaggtggcattaatatcttgcagtaatgaactaattggtaaaaaccgttttgtttacattaaaatggttcaaaagccagcgacacagcgatgattgtttccatttagcagatgtggatactgaggcacagaaaacggtcaagccttctgcccacagtcaccagaaaggaggaaattcaagtctggggttgtgtggcttcagagcctgagctcaaccatgacgagcacactgaaaaggaaacccctcctaactaactcccgctccggggtcctttaagagcgtcagaacccagaactgagtaaaacaagatcaaagcgtatgtaaatacggactaggggctgccgggaaataatcactacggctaggccctagggaaagcagacgtcggagtcctagtgcgcctgcgtagccccatctcgcctttccgccccacggcctagcgaggcccatctctaacccacacaggcccaaagttgtctaatgtgcgcaggcgccctgctgtgagcccgcctccttctctgccctgctcttgcgctctcgctctctcagagttcgtctctggctctttgtacgtcacttcctgtttgtggcgcgagagggcggtatttccgtccagagggtgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgagtgcgccagcgcgtgtccccgaacgccccccccacgatggtcgcgtccgggccccccgcggtgccgcgatgggctgtaccacccgtgcccggcggggggaccgcggccctcgagcccctccttcaggagctgagtgggggtggccgagcgggggcggtgggaccagcctcggggggccggggcggtggcggcgggccataccactgaggcggtggggggagcgctgcaagtttgcgggacggggagcgcaggccgcagcgtgcgcgggccgggggctggacctttcgggcgcggcgggcagatcgagcctggcgtgcgcgggctaagctatcgagggggcgcgccgcatcaagtgtagagggctgtacctttttggcgctgtggaagccgttgctgtgctgtatttacaggggtgggggcttctggggaggatgcttccccaactgtggctgggttatatcaccacggcgttgggggagccctgcttagaacgtaggggaacccaaatcagaggactgtgatgtttgtgatctttaagggactgggacggggcgggacaggccctagtgggttttaggggcgtattttgggaggactgtgatgccgattggtgaggaggggtttctgtttcctgtatttgacgtgtgtggcgttgggggtttacactgatctcagcctttattgaacttcttaacgactctggagggaacgtcatggttactggggtgctttggaccatggaggtgctgctctggattccattaccctctcagattatttaccaggcagtaacagttctttccttccataggggagggaggaaagctgtgttagaagtcactgaagttgtctgagccttaacattctgaagaggaagagggattgggcttggatttgaggagccgtgcccctgcacccgcttgttaaaacttgggaggaaggagtgtttgggggaacacctcttccccccagggaagctctctgggggcatcttgatcttgggattgtgaggacctcttcctctcatttggagacctcttggggctcagcaagacgcctgggctggagtaactagagcctccaatgggctgcttttcaacttcatccactcctaccttcccagagaagcagcaggagttcactcgtgggctgaacttggttggcagtggatgtgaagggtccaggaaccaacgcagaccactacatgctcctctgtcgctggccacgaagctgtttgtgtctcccagttaccagctcggtcacacatcatgtttacactccccaccaaggcagtaacagttggccttgcagtgaggccgggagctgttttcccagctgttcctctttgcataggccaaggggacttggagtgggggtgcccctggcccagcctggcccagggaggaaggctgctctgaagggcttgggacagtcagatcccccatggatctggtgtcttattgtggtctgtgggctggtgctgggagcagccagccccagaggtctgtggccagtgtccctgctccctaggccagatcatgaccttggcttgccctgtagcctttgctctgggtctggagttcccagaggactggctgcagtccctgattgacccagcagacctgggctggtgatgtggtcagagggggcagatggttgcccctagtccgcagcagtgacttccaagctgactggcttccgtggctcgtggttcctggagagaaaggtcccacagtctgtgaggcagcggcgactctgtagaatctttctccactaggggtttgttcctctggtcctctcctgccagcttttagagggtttgcctgatggggctaacagtggcagtgaaaacagtaatcatgaaattgatggctgacagtaactgagtgcattctgtgggccacacactgtttggaatgcttcatatagataaacttgctgaatacttgaattctagagcggtaggcgctgttgttatgctctcccttttagatgagaaaacagcatctcagagaggcagatcatttccagagctagtggatgcccagtgtttatagcattcaccccatgccaggcgtgtgacagggcttttgtacatgtgatctcacttaagtctcaaaacatacctgtggttaggcctattttatggagagctacgagctagttagaagtgtgataccattttacagatgaggaatcatttcactcactgtgaagtgcaaagatttcccagaggtctcatagctgaagtgggagaggtgtgatgtgagcccttggccaaccttggcctcagatcgtcttgtcaaggagaaactggaggagtggcttttgtctgtgagcatatactctgcccagccctgtgctttgggctttatatggtatttgtgtccttttttgcagagtccgaaattgaagttcagaggaagaattgccttccaccgcatcttatcagaccctatgggtgccagggtaggatttgaacccaggtcactgagcccctagtgccatgcattccttgctcaccaggttccaggctgggtgaaaggaaggaaagacataggatagagtcacctctgtcctctgtcctctacctatagaggtgactgtcctatgtctttccttcctcttacccctgagcctcaggctgccctgagcatctctgcctacagccagtccagcatttcttggtccctcctcagagtggaggcaaggcatcctttaaccctgggcaggtgtgtgctgggagaagaagacagcaagagagccatgcagggggtgacacagctaccagggacctgcgttagctagcagcaggacggtgaagtcggttctagctctgcgaccttggaccacactgttcactcccatacagtggtctcagaaggacgtccaccttgggctgttgtgaggattaaatgaattaatccacgagaagctcctagaatggtgcctggtactgtgtaagtcttggttggcagtcatgattatgttatggaacggaggcatccagcctcccccaccccctacttttggtcccctcgagcattccgggatccagctccccagcctggcccagctaggatccagaacttcaatgttctggtttccagcctctgtaaagaggtgtatggaagcgagtgagagcacagggttcaaatccagccgtgccactccatggctgtgtgaccttgagcaggctccccaacccttgtgagctcatttcatcatcggtgccatggggatgatgataattcccacctgataggattattgtgaaggctgagtggattaatttgtgggaagcattcataactgttctggcatacaataagcctaccggaaatgtctcctcactaagaacagtgcccgacacatggtgagctgttggtctgtcttagcaattgtaattcttagtatttctgccgggactttgaaggcctttgccagttcacagaaccgtgtcagagagcactaggaggagatcagggctgaaattagcatctcagttttacagatgcagaaacagaggtcgggggagacatgcaatcaagtcagaactgacaagggcagctcccgggcccactcctcttccacgcagtggctttgcagccctgagcgcctccaaggtagacacactggagtcttttcagaggtcaggctctgtgcttgtttttttttttcttttgagacagggcctccctctgtcacccaggctggagtgcagtggtgtgatcacagctcactgcaggcttgacctcctaggctttagtgatccttccacctcatcctcttgagtagctgggactacaggtgcatgccaccatgcctagctaatttttaaattttttgtggaaacgggagtctcgctatgttgctcaggctagtcttgaactcctgggctcaagtgatcctcctgcctcagtctcctgagtagctgggaccgtaggtgcatgccactgcccctggttcccagcccaccacagctcacagctctgggagtggcaggaaggctgggcctgggcagggggagcagcagaagtgcctgcaggggttggcaggggctgtgctgcactggcctgtgggcctgggtgagaggtgaggatggatcctaagggtattgtggagccgaggaaaaggtttcactcatccgccaccatttactgaacacctcgtatgtgccagcgttgcatcagtactgggaatacagcagtgtacttgccaaagtccctatccttgtggggctaagcaagaccaacccgaaacaggttaataagcaaggagccggttagagggggaggagctaggcagcgaattcaaatcaggtgacagactgggcacttctttagatgcatgcggctgtggggagggcctctgagctgatcccagtttggcaaggtgaggcagtcatgtgggatgggaggagaaggaacagccctccaggtggagggaaccacagtgcaaaggtctgaagggaggacagagcttggtgaggtgcagggacaagcctcacggaggcctgtgtggcttggcagagcgagggagcagggaggagatgagtcctggggctgcggggcaggcagggccctttcactgggagccttgtggactgtctgtgaaggagtttggaatttcagcaggaacagcctggtcagattcagggtgttagcaggtgacccaggagccggtcacaggctcctgcctgggggcgtgggtagatttgactgagcggagcagggcgtttcacaggcctcccacttcccctccagtagcatcactgccttacagccagcaaaggcctgagggttgcctccctcctgtggttttcacaccgtgttctccagagcccgtggctgttacttttagggaaagaggaggggaggctcattgggctgatttctctgcccattcctccccaacccaaccagccggactaatactgaatagcaacgcagggcagcagtcacacctgatacagacagcacccgctgaccctgcgtccacgctgccgtgggcctgtaggcctgcgccattcccagtgctcctctggaattggaaagaccagggcttgtgactggcgcccagcacccaggtctctggttgggctcaggtgtggttgatattacgaaggcaaaataaatgagggccaggttgagagtgtgggcatgtttctccactatagctgggtgatcagggaggacctccctgaggaggtgacgtgtgggtagggactggagtgctgtgagggagccatgggaggatctgggtgaagacccattagacccaggaggaatcttctctgattcccgctttacaagtggtgagaactgaagcctggagagcctctgtagcttgtgctgagtcccccaaccaggaagtgttggggacaggctatgaatctgggcttccagagattcccccaccacagctcagtagcccctggtgagtgtgacttctgatcccacccatgggctcacccctaaggcttggtgcgggagcaggcgctctggcttttttttttttttttgaggtgtgttccagggtatcttcctagaaggagcagaacccctcagaacaaaccactagggtctccagaaggcccccgggatgggttgggatggaaaggagtgtctttcagacttgagctccaagcccctggaggacccagggtcacccctccccgggcctctcttcagcttcccagagctctcagcggaaggccctcaaccacaggcctccgggccgcacggtggggtggttccatggcaggctcttctggacagccagccaagcagcgagaggcccagctgggggagacagcctgggagcaggaccaggagggagggagtgagtgtgggaggggcgctgggtgggagctcagcctggcccccttggggcaggacccactgccaactcggcacccacagcagggcccaggtgctctgactgtgccgagcgagggacagcaagccgggtcggccaagaggagactgcatgtcagaggtcccagcaggagtttcttcagcccagccgtcctgctggagaagctcgttcgcagatgttgtttctaagggtgaggccagaaacccaagtcttcctcggtttgccactttgtgggccctttccgaatgggctggggcagttgccgctccccggttctcttctccagcctggcttcaagttcttcatggtctggtgggtttttggtgtacacttacccagctggggctgctgagtgacctggtcccgggggtagctgacgtgggtgagaaccctgctcttggcacccctctcggtggctgtggagctctggggccttatttcttctccctaaggtgcattttgctcagctgtaaacgggaaccttcctgctgagtggggcggtggggaggatgcacggagctgctgcgttggaaagcacaggcctcctgaggaggcggcgggatgaatttgggctgatgctactcctggtgattgccagacaggactgagggcacctgagagcacagaaggggctctgcagggcagtgggcacaggctcgttgttggtccttgggagagagtggtagggcctgttagctgatgggagggctccagacaggaatgtgaatcactcccaccactgtactcctgcccaaccagacgctgcatattagctctacaaacctgcacagcagcctgggaggtgggcagtgttagcactcccatctcgtagataggaaactgaggcccaggaagccacatagaatattggggtcattctcgtgagtagttcgcctctcagtgctgggcactgctgcagagcttaaggtgtctgctctcactcatcctcaccacagcctggcagctcgctgtcccgatcgtccccgttgtacaggggaggaaacgggcatagagaggttattggatttgctggaagtcagtaataggcatgatggttgaaccctgctctgtcggcgaagctgccttttgaagacagcctcatcttcttgccctgcctgctatgactggagttgtcactgttgtcatcatgatttcttttctgctttctcttctcctagacagagctggcacaaagtaggcctcagtaatccagaaatgactccattccatgcctgcttgggatgtggggtgtggctgcttctctccacccccaataccatgaccttggcccctcccaaggggggcccagggggaagagatgaggatgggaggcaccccctccccactgccctaggggcctgattgctgaacagcctcaggagccagcctttggctgttcttggtcatttgtgtgttccatctgtctccaaatattgattgaatcacttctatgtgccacgtgtagttctggatgcgatcggaggtggcagagaggttgcattggcctgtgagtgcttggtgtggctgaaggagggaacagagatctagctggactgggtgggagaggggcttgggaaggctgctgaggagcccctgtgatgtgagagcccgaggaagtgggctggacggggtgcagccaggtaaaggccgcaaggaaggcgatatctggatgtgctggtggaacagcaggcccatgtagctggagccgggggagtgggtgagggggagagagcagggtggcagggctcagggcctgggctatgatggggatccagggctttatccccaaagagaagggacacaggtgggtggggagggacctgtgtgggagagagctggctggattcaggtggcagccagggatggagaaagcagaccatattctgctttggagacagggcgccctagagcccagcttctcaaactggtgtccgaaggccttggcgggtgggaggaggtgtctgcagggcattgactctttttagctgtgtgttttcatttagatgatattttcaaaaagttagtaggggcatgttggaaattattgggatgattcctttagaaccaagtagtgacagcagtaacattagctgccactgcatggctctgacaggctcaggacggcccctgatgtcagagtcctttatgtaattgccacctatttttcaagcactggccctgtccccagctgtgtgtgaagccatctcattgggtccccaggacaacccatggttatcagaaaaatcatctttttaaatttttcattatttttttgagacagggtctggctctgtcacccaggctggaatgcagtggcaccatcatggctgattgcagccttgacctcactggctcaagtggtcctcccacctcagccttctgagtagctgggactacaggcatgcaccatcatacctggctaatttttttaaaacaattttcagtagagatgggagtctccctattttgctcaggctgatcttgaacttttgggctccagtgatccacatccctcagcctcccaaagtgctgggattacaggcgtgaatcactgcacctggcctgcaaaaattatcttttgagataacataaacatgtgcttgggcagattggtgttaagattccattctacaggctgggcacggtggttcacacctgtaatcccagcactttgggaggccgaggagggtggatcacgaggtcaggagttcagtaccagcctggccaagatggtgaaaccctgtctgtactaaaaatacaaaaattagccaggtgtggtggtgggtgcctataatcctagctattcgggaggttgagacaggagaattgcttgaacctgggaagcagaggttgcagtgagccaagatcgcactactgcactccagcctggcgacagagtgagactctgtctcaaaaaaaaaaaaaaaaaaaaaaaaaaaaaaaaaaaaaaagattccattttacagatgcggaagctgaggttcagagaagtgacctgtgtagcctggaagtggtagagtcaggatttgagttgactagaggtgtgagtttgggcctgagtcctgctccaattccccaggtaagctgcgttggggtgcgggagagatggggtatagcatgggagcttccagccgcactgggatgatctggctcctcttgggcctgtgagagtcacatccctgcctcctgcctttaagctcccggtgcttaattagcaggaattctatagaattgcactccagaatggtagctactagccatgtatggacttttttttttttttttgagacggagtcttgctctgtcacccaggctggagtgcagtggtgtgatcttgtctcactacaaccgccgcctcccgggttcaagcgattctctgcctcagcctcccgagtagctgggattacaggcgcctaccaccacgcctggctaatttttgtatttttagtagagacagggtttcaccatcttggccaggctggtcttgaactcctgaccttgtgatcgccccccgcccaccccccccccccccagcctcccaaagtgctgggattacaggcgtgagtcatcgtgcccggactcacatatggctttttaagttttaattaattacaattaaagaaaagtaaaaagtcagttctttagttgcactagccatcattcaaacatttagtaaccacatttctgtcgttatggaaaggtctgtgggctagttctgctctggttgcggtccctctcctgcacctactcgctgtgactgtgtgcatgtggctctctccctgggcctcagttttcccatgtgaggaacggggatagtaacacaggctggctgtgaagatgaacattaatccatgcctggtgctttgtgagtgctcactgagtattagccttgatgcagacccactggtttctccttttgccactgggccctgccctggagctcccagggaggtggtggcgatgcagagcgacgtgggtcagggattccccatgcagtccaactggagggctcccgtgcatgcgtgcacatcaggggcggtaaggaagggctggccggggtgtgggaggaggcgacacaagatgggaggtggccctgtctcttgggagcaaaggcagaaggaggtggaggcagctcagggctcggaggagaggggtccgggctccttggctgtgtccctgctgtctctcgctgtgggtattcaccgaatctctcccatcctcggttttcacatctgctgcatgcaggtcctcatggttctcaagtgaggcaggtggtgagcccatcaggccagtgcccagggcttattctggggacagctcctggagaggaagggctgcctccctaaggactcctgccctgccctgggtgcaaggggttccacctgctgcccctcccccactccccagctcgcctcaggcggatagttcccctctcactccaaataagagccacaatgctgacagtggcccccaaggccctgcccagcggtccccagcttcctctagctacatctcccggccctccccttcacccactcctgtaggcgcctcgaacgcgcctcagccctgctcctcccctgcctgcagcgttcctccccaggtctcccccggctctctcacctgcttccggttttgctcagactgcgctgcctcagtgcgcccttctgtcaccatcctgtgtatagtcggaaacccctgctccctttccctgcactgaatcttccgtgtgctccttttctccatggcatttgttagctttggctatcctgtctaatttgcgtatgtatttattttttattttgctgcctgttccctcattcccccaactccccaatggcagggagttctgttttggtcactgctgaatccctggtgacccgagcagtgatgatgcagagttgttgtgatatttgtggaatgaatgaatgcaggattttttgttttaccttcacttggcacaaatgctgtggttctgttcaccactcccccctgaagtaatgaaagttatgggcccatccctgtgctgagtggagctggggacacagtgggggctaggacagactgtatccctgccttgtggaacccacagtccagtgggagaggcgacattacccacatagtcatgcaggtgacagaggcaagtgctgtgaggggaagggaaggctgagctctgagagtccgctgctcgtgggagaggggtggtcagggaaggcctccgtgaagaagatgggtgaacagagtgccaggcaaggggtacagcatgtgcaaaggtcttggggtgtgagagcagggagtcttcatggggccaggagaaggggagattgtgtgttggagcgagcagaccagtgaggctggagagcaggcggggccaaggcagatggcccctggcagcctccataggggccttggacgtgatccatgggcactagggagaggtcctgagcaggggagggacagggtcagaactgcgtggaggatcccgctggttgcagcatggagccctcagagtgtatggagcccgtggccaagcagactagaatatttgacatgatttctgtgggtgctgtaaggccctgggtggcgtgagggggaaggtgtgtgtgtggggtggcagggaggagaaggaatctgctctgtgcttattcttgtccccgtttcttttgcagcctgcccacggcttcaacctgcctccagccccacctgctccaagcagacagatggggcgagtgtagggagtgtgtttaaaagaaaaaagaaacaaaaagtctctctcttttttttttttgaagtacccagaccttttcaggaaaaaaaaaaaaaagtttcttcagtgccaccttctcaccaaggaggtagaataggtaaaaattcacctgttcagaaacatacagtatagaaagtgaagtttcccatgtctccacccatcagaggaaataataattttttttttttttttgagatggagtcttgctctgtccctcaggctggagtgcagtggtgcaatctctgcttactccaacctctgcctcccgggtccaagcaattctcctgcctcagcctcctgagtagctggaattacaggtgcctgccaccagcccggctaatttttgaatttttagtagagacagagtttcaccatattggccaggctggtctcgacctcctgaccttgtgatttgcccgcctcggcctcccaaagtgctgggattacagtcatgagccaccgcgcctggccagtgatgataatatttgatacgtgttgagcagttgctcttacaggctcttttgggaggacttcatgtggattaactcactgaaccctccaatagccttagagataggtatatgcagttattatctctaatatacagatgaggaaacagaggtgaagaaagggaacatgacttggtgacttgcccaaggtctcacagcaggtgacacagccagggctgaaaagctggcatttggttcctgaggctgccttgcctcccgcacccactctcctgcctcttagtgtggcgtatttccttcggatttcttttttctgtgcgtgtgacatttaaacacatacctccccgtgccctgaagtctaagacagtatgccctataaggtccatcattgatcatataactgcttttctgaaaagaatgcgataggtgagttttgtccatggattgcaaggtacatgccaatctcaatgacatcagcatgtgaaacaatacgcatattgtagaattgaggtgacagggcgtgtgtgtgtgcgtttcagaaaaggcatcccgcctgcattctgtcgtgccgcgagccttcgttagcgaatgctgatggtcccagtgtcagcacagcagggctggtttctgtgtttctgtgctcaggatggcttgttgtgttgtgtggccagaccgtctccacgtgctgggtgctgtgctgagcccttccctgcattagcctgtgatgaaagcgctgctgtctgtccttgcaaggacaggaggaaacggaggcttgggagtctagaaagtgggcaaacaaggaccccagtccagatctgcctaactctcaaggctgtgtggcatggtgttgtgggggagccaggccgcctgtacttcctgagatgaagtcatagggcaagtcatttcacttctgtgcctcagtttcctcattgtcatagaaacagtaggagtgtctgcctcaaagtgttgctgtgagggttatattggtatgtgcgaagcactcaaatgggcctggcacgtggtatgggctatgtgagccttgctctttttagtagagtcatgatattaaccaatatatagcaccagacccctgttgtgagcttttagattgttgccaggtttccctatttcagcagtacatacttaggacagcggttgtcagctggtggtggttttgtaccccaggagacatttggtgatgactgaagacatgtttgattgtcgtaaccaggggaaggtgttctgttggctttagtgagtagagacccaggatgctgccagacctcttcagggtgcagaagagtccccacatcagggattctctatccccaaatgtcactagtgttgaggctgagaattcccagcttagaacttctgtgccctggcactagcattttctgcaggagaaattcctccaagcacatgtacattttccactttatgagttttaccagaatgttctcacaagacgctgggaccagtttatagagtggtgaatggctggtggcagatgagggagttggttccctcacgtcttgccccaggtgcctttctcctgagttcccatgagcagatgctgcctgttacaccactagttcctgttgtctttgggttttttggtttttttttttttttttttgagacagggtctggctttgtcacccaggctggagtgcagtggcacaatctcagctcactgcaacctctacctcccaggctcaggtcaacctcccacctcagcctcccaggtacctgaaactacaggtgcacaccaccacacctgactactatatatatatatatgtatatatacgtgtatatatacatatatatgtgtgtatatatatatatatgtatgtatgtatgtacgtatgttttttttttttttggcagacacagggtttcaccatgttgctcaggctggtctcaaactcctgggttcagaggatcctcttgccttggcttcccaaagtgctgagattacaggtgtgagccaccgtgcccggccagctttttttgtttgtttgtttgtttgtttgtttgtctgttttttgagacacagttttgctctgtctcccaggctggagtgtggtggtgtagtcatagctcactgcagcctcaacctcctgggctcaagcaatcctcctggctcagcctcccaagtagctgggactacaggtgtgcaccaccacacctggctaatttttatattttttgtagagataaggtcttgctatgttaccaaggctggtcttgaactcctggtcttaagagatcctcttgcctcagccttccaaagtgctgggattacacgcgtgagccaccacgtccagcttcctgttgtctttgaatttatctcctgagcaagtcttcctccgggcgctgtggaaaggcacagatctgagtgcaggcgacagaggctcctgagggggtcgctgccacctccccaatgagcctccgcagcaccaggaaggagccccacccaccagctccagctccaagagacgcagatctctgcttccccacctgcctccctagcccatctgtgctgtctggcatcaaaatcaggtcagtgagagggggcgagagaaaaaggacttagtaagtggcaaggaaaggaattgagcttattttgagcctgttctgggcacagggcttcactctgtacatgttcattccacagatacttattaagtacccactccactctgtgcccaacaccctacaaagctctggggatccagctgtggctaaggcagccaagagtcctgcctttgtcgtgctgacattccagtgtgggtggtgggctgtcagcgtaagcaaacacatacagtaacatcggtggtgatgggtgcttaggggaaaatgaagggtaagggtaaggggaggtagggtgggcatgctttgcctagggaggttaggaaggcttctcaagaaagggacgtgagcagaggctgaagagagtggagaggggcctgagtttccacctgagggtgcagtgcctgcaaggccctgaggtggggcgtccccatgtatcctggcagctgagggagccaggcactgctgaagtgaagtgccctcagagaagcaaagggggatgttgcaggccgcgtagggtcctggggctgctttggggattttggcttttatgttgcatgggagggttcgagcggagaaggggtgggagctgactcaggtggtcacggggctccaggctgcaggaggggcgtgggcagagtgctgacttctttcactctataacattctctcactccttccctgctgtattcagcagcagtttagtccttttcgttgctgagtagtgttctactgtggatctacgtgtttgtttattcattctcttgtgggtagactcctggtctgttaccagtttggggttactgtgaatattgctgctgtcaacattgtagtacaagtcttttgtacatacactaatttccttgagacgaattgctaggtcgtgggataggcatatattgagctttgattttgactgcttaacagttttccacagtagttgaaccattttgcacctcccaccaataatgagtaagggttctggttcctctacatccgagccagcagttggccttgtcagtttttaaaattcgagccatcccaggtaggtggttatgatttgcatttgcctgtaactaatgagattatgtatgtttcttggttgtgtgggtgtcctctcctgtgaggtgctcttgctctttttaccttgtcttgagtcaacagctgcagctctggcccaggcactcagaagactcatgcccaggaaccttaggaagtaatgagtgtggtggggccgtgcagggactcccctccgcagggcgtgctatgggggttccataggcgagtctctgtccccctgcctgagtgtcctccattggcagccccccgagtgatcaggccatcttttttttttgagatgtagtttcgctcttgttgcccaggctggagtgcaatggcgcgatcttggctctccacaacctccacctcccgggttcaagcgattctcctgcctcagcctcccaagtagcatgtgccaccacgcccagctaattttctgttttcagtggagacaagatttctccatattggtcaggctggtctcgaactcccgacctcaggtgatccgcccacctcagcctcccaaagtgctgggattacaggcgtgagccaccgtgcccggcctaagccagccatcttcttggctgcagtggctggtatttcatcaccacaggactgcgtcacggacacctcagctgaggcaccaccctcagtgggaggacagggcaggatccaggcgggacgcaggggatcttccaactcctccccctgctctccctccagctgtgctgactccttagttgctgagatgagcttgtaaaaagcagctctgttgatcccagcagcggccagggcctccgctgcttctcggctgggagacccgaggtaaacagcttcccttctctcagcttctgtcctcatctgggcatggtcactgactgtctggtggggtgttgggagcattcaggagagactccatgggagcgccggcaccctgcccaaggccacccagctggcggtggctcttggactctggaacccagaccactcttggccatacctggctgcctttgcttctctctggaataatggcagccatgtgtttggctgttcactgggcgccaggcagtaggccgagccctgggcccacagtgggtactttagtgctgctgcattacaagggccctgagaggcgatgtccctgggccgctgtgggccagcgagaggggagatgagacatggagcccctgttctattccctccacatcagcccctcctttggactctgagttctccctcccagccatttgggaagtattttgaactgagcttgcatcagggaaggtgtggtgtaggtccgtgtaggggacgggcttctctcagtcccagccatagcccagaaggcccttggtgttctcccctgtccacctctctcgtgtttctcctcaccaggccccctcctgcctcaggtccttgcattttctgttcccctgctgaaatacatttcctcatgtgttacacagctcactccctcagttaactcgggtgtctgctcgcaagtcccgcacaccaagctaacatcctgttcttccactctccagcctccccaccacctgattatttgcatattcgtgtatttttctgcccctcacaccagactgtgagcctcatgaaggcagggctgtgtcttagtgacattctgttgctggtaccatccggggtctaggatgcaccccaaaaaagattggtgtcatgaagagagtctggtagtgtgtccctggctgtgtgtggtcctggggtgggggtcagttggggacacttggcctctttcttcatgtgctcattagataagacgctttgctggtctactgcattagcgttaataggtgttgggagggttgctccgagggtgcacaaagagcacacagtgcagcctctgaggtggggaaggcttcctggaggaggcactggtttagctgagacctcaaggaagagagagaagaacgcccagaaggaggtgctgtccctgatggaggccagagggaagggcttgagtgacagaagcataacatggagagtcaggtagggcggagaggctggagaggtgcaatagtcaacgtcatggtccttagcctttcccgagggctttctaggtgcacgtctcagctcatgcacctggaacgcagggcagcagaggcgaggtcctgaagggccttggatcctcagctgaggagtttggcttttttgctgggaacaccagggagccacaaaggttctgagcaggagaaagacaggttcagcgttggggatccctctagctgctgaatgtggggtgagtgggagggagcaagagtggagcgtaggaactcggggaagaggtgggggcagatgggggcagacctgactagagccaggccgcgggcaggatggggagagatggtcacgttagaggttgacacacagaacagtgggagatacagaaatacatacatatttatatattttttgagacagggtctcattctgtcacctaagctggagtgcagtggtgcaatcaaggctcactgcagcctggacctcccaggctcgagtgatcctcctgtctcgaatagctgacattacaggtgcacagcaccatgcctggctaattttttaatttttaatttttttgtagaaaaaaattaggtcgtgagacaagttctcactacgttgcccaggcaggtctcaaactcctaggctcaagggattctcctgctttgacctcccaaagtgttgggattacagacatgagccattgtgcccggccgagatgtggggatgctgaggattgagagtctggcagtcctgtgtgcttgggttgtggggtgccgggcatgttgctggcaaggggagccccttattgctgctcccagcctcgcatcattgcctttgcagcttggagcccagaatgtgatttctcaccctcttgtttacttccctgtcatgtccatcttgtctttcctcccgcttcctaccacttacctcccttctttctgccgggacctgggcagcctgccactgtcacatgccaggcagtagcgtgtccggcccaccagctcccctggggcacgagagaaagctgatgcccatggtgtccctagagccagctgccacttctctgggcgccaccgtagctcccgacctgctgtccgcaaataaccccaggctgggaaaggcaaaggcgccttggtctctgtggaccctggccaggccccaggctccaggtaggggcccagctggcgctgcctcgcgccctcctcccctccgttctgggaacctgagacgaagcagtggcctcggcgtccctcagtctgttggttgctggtccctgaggacagaagtgaaggtcttggggtagggatcagggcctcggtcaagcccccaggactggcttctaggccccagaccgtgcatacgcagtaggttgctttcttgttcaagatcccggattgtctgagacctgtcttttctctgtcatctgatggggggagggaggccgctgaggctcagggaatggcatgggatggcatggggggacgggagtgtgcttagtttgttgaaggtggcaggttggtggcttcctggtttggaaagaagggagaggggagagagagaaaagagtgtgtgtgtgtaagatggtggagggacaggcagatgctggtggctctgcgcattccctcaggtaccctgggctgcctcattcatactgggttacctcagtgttgggccatgggaatgacacggggagggcagggcacggctaccttgatgcttgctcagtcaggagtgactgtgggtggaggggccacctccccccagcatgggtgtcctgagtttggggtctggcctgcgcttaggccggggagctctgcttcccccagattggggtcgctggggacattgccacatctctctgctcagaatgggtccttgagagcgggctccacgccacccttgctggccttaccctttgctgagtgggcagaacagccagagggcctcagagcccggcgtcctcagggaaggggctggtgtggaatcccctcccgccctgaccagctcctctcttgtcttgcagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtaagaggccgcttttgcccgccagattctttctcccacgctggctcctcctggaaagctgtgccctgagaggcagaggcggagggtcttaccagcctgaggagccagcattccgcagccccaggcccacagctgcttatgcccccatttcgtggactccttcagtggtcatctgggcaggagagcagggatctgactgtgcatgagtgatctcattcatagccccattttatagatgaagaaactgaggcccagagaggggaagtcacgtcactgaactaacacagtgaggcagtattcagcattcattcagttagcaagtattcattgactgtgtgctgtgccggatagccccgggctccgagacacagtggtcccctgatggagcttacattccagtgggggtggggcaggcagtaaataagtagacatggaatgtcggggtggcaagtgctggggtgaaaagtgggaactgtgagtgagggacaatgggctgggggcgggggggcatcaagaggctgcccggaggagacggcagtggtcagaggcctggagcctggaggaggtgagacgctggctgggcaagggtgtcccagggagagggacagcaaggacagaggctcccaggtggggatgtgcctggtgttttctggtaacagcgtggctggagcagtgtgagctagggcgagctgggggaggcaagcagaggagcaacgcggagtccagctgtgtcgcgcctgcaggtcatggaaaaggaccttggctttggcactccagacgagagcagccctgtgatgtcgtgagccgatgcgtggcctgatccatttgtactagtgggaagctgaggtccccttttagtgaagttaggacagggaagagaccctttttgaccccagggctgtttgtcccaaagtggctgccacgcaagactgggaggcagatggggagaagcgccacctgctgagagatggctttgtcccaggccagcttctgtgggcctccccctggaaagaaggtccccaggtgtggcggttggctgccctgtgtgcacttgcattcattcagcaaacacgtgctgagcagcgcctgtgggccaggcgctgttctaggtcctggggtccagcagtgagcccgacaggcaaacatcccatcctcgtgttagtatcttgggcgctgacagggaggcagacagctcccaggcagacatgcatgtctcacggtggcgcgagccatggagaaaaaacaagcaacgtgaggatgggagggcatgaggcaggcagggcggccagagggggcttcgctgagaagggggcatctgaataaaggcctgaaggaaatcggggattgagcctcacagttatgccagaggcgacagccaatgagtcctgagggggtaagtgggcttgttcaaagagggggcaggaagctggcgctgcaggcatcgggaagagccacgcatcctgcactgtaccagcctgcagacgcagacagggagcagcgatgagggatggacgcccctccctgggagcagcctccccacctgactgagcagaggagattcgtgtcctgctgctctttctggacagagatggcttttaaggtcccttggcccagtcccccagcctgagcctggagtctgggtttgttgatggagcttcctgagtcttggcagctatcaaggttctaaccctggttctgctgcttcctcttagtgcaactgtgagcaagccatgtcacctcactgagccttggtttcacatctataaagtgggttaacaagccagatctctgatgttgtcagctctacaagggtaggcattttcatgaggcttcttcacagtggtatccccagcacgtctaaaagtggtgggcatacagtaggcactcagtaaatggttgttgaatgaatggttggcgtggtgtgtgggtggtgtgctggggaacacagggtcatgggctcctgtcccgtggcctgcacgtgcggaggccatggctcattaggctggactgtgagagccttgggatgggtgtggaactgttggaggggcaagagtttctctctggtctaggattactgatggcattaaatgagtcttggcccctcttgggccttcagtgtccgcattcatgttacaaggggccagatgacccagccacaggcctgcctctgtcatctgggatggcctagctctgacacacctgtctcaggtttgcaccctacacacacgcttgtgcacacctgcactcttgggccttcccagtgcccatctttctgagtagcagctggcagaggtgggcaaggtgaggtgggccctgctgactactgctgttttgggacctgtaccaccccaccgacccccttggtggttaaaataatggcagtgctggtttactgagcacttactgtgtgccagacacctgtctctgctctaggcaagcctgattttgttgaatttttatagatgccctgtggagcacatgccaccttacagactggaaagctaaggttcagtaggaagagtgacttgcttgaggtttcagcaaggagtgggtagagctgaggttggactcaggccctctgactcctgaactagtgctctcaaggcctggcccacgtgctgcctctcacccagcaagctgtgcttaaggccaagggtgtagtaatagcacatctaatcagagtcactcatgccatgtgctggtcccacttctgacacagctgcagcacaccaccattagcagagcacctgccctctgccacgccccatgctgggctccatctgccggtttagaggcagacggtatagtagtcaagatgtgggctgtgctttccaattctggctctcccaggtaacagctgggaaggttgggcaaactaataggacctctctgtgactcagtttccccatccgcaaaataggaatacaattgtgaggatatttttccttctacctgttttttgtctttttttttttttcatagatatatggtcttgctatattgcccaggtgggtcttgaactcctagcctcaagtgagtctcctgtcttggcctcccaaagtgctgggattacagttgtgagccactgcgttcagcttttaggtttcttttcttagcttgttaccaaagtatgaaaggccacagataaatgcctggataataaactcgccccaatcccagtgtacagttcaagaaatagaataagacggtccccggaagctctcccaagtgctcctcccaagcagttaccgctctcctaacctccagtaacacagatgaggttttttttagtttttatcctttaaaaaaaaaaaaacggggatgaaatttacataacgtgagattaaccattttgaagtgtatgattcattggcctttagtatatcacaatgttgtgtaaccactacctctatctagtttcaaaaccttttcattaccccaaaataaaactttgtacccattaagcagtcagtttttgtatcctatgtcttagttcattctgtgctgctataacatattacccgagactgggtaatttataatgaacagaaacttatttcttaccgttctggaggtagggaagtccgagattcagggttggcatcttcttgtcacacgtcccatggtgaaaggggaagggtaagagagaacaagacagggctgaacttgtcttgtttttttttttttttgagatggagtcttgctctgtcgcccaggctggagtgccgtggcgcgatctcggctcactgcaacctctgcctccttggttcaaggaattctcctgcttcagcctcctgagtagctgggattacaggcgtgtgccaccatgcttggctaatttttgtattattagtagagatggggtttcaccatgttggccaggctggtcttgaactcctgacctcaggtgatccacctgccttggcctcccaaagtgctgggattacaggcgtgagccattgcgcctggccgaactcgtccttttataaggaacccactctgtgataatgtcattaatccattcatgagggtggtgctcccttcacccaaatacctcccatgaggctgcattggggatcaagtttccaacacatgaactttgggggacaattcaattcatagcaccccctgtctcctggtgtctgctaaccaccagtttactttctgtctctatgaatttacctactctggacatttcatgtaaatggaatcatatgtggccttttgtgactggcttctttaacttagcaacatgattttttgttttgagtcagggtcttgggctatcgcccaggctgcagtgcagtggtgggaccttggctcatggctcactgcagcctcaacctcctggtctcaagtgatcctcctgcctcagcctccagagtagctgggactacaggcaggtgccaccacacttggctaagcttaatgtttttgaggttcctctatgtagtagcgtatatcaatatgtcgttccttcttatggatgaataatctctatgttgtagatgtatcacattttgttatctgttaatttgttgatggacattgggatgatatattctttttttttttttttttttttttttttttgagatggaatctcactctgtcaccaggctggagtgcagtggcgtgatctcggctcactgcagcctccgcctcctgggttcaagtgattctcctgcctcagcctcctgagtagctgggactacaggtgtgcgccaccatgcctggctaatttttatatttttagtagagatggggtttcaccatattggccaggatggtctttatctcttgaccttgggatccgcccacctcggcctcccaaagtgctgggattacaggcgtgagccaccaagcccggcctcggggtgatatattctatatttaactttttgaagaagcagctgcaccattttacattcccaccagcagtgcatgagggtgtcagtttatatccttgccaacacttgtttttttttcattacagccatccttgggcatgtaaagttgtacctcattgtgtgtgtggatttttttgtttttgttttgttttgtttttttgagacagagtcttgctctgtctcccatgctggagtgcagtggcacgatctcagctcactgtaacctccacctcctgggttcacatgattctcaggcctcagcctcccaagcactgggactataggcatgtgccaccacgcccggctaatttttgtatttttagtagagatggggtttgatcatgttggccaggctggttttgaactcctgacctcaagtgatccgcctgcctcgacctcccaaagtgctgggattacaggtgtgagctaccgcgcccggccttcatcgtgattttgatttatgtttgccagatgactaatgatgctgaacatcttttcatctttctgttgaccatttgtgtatctttggaggaatatctctttgagtcctttgctcattttaaaatcaggcagtttgtctttttgttgttgcattgtaagagttctttatgtgttctggttaatagacccttattagatttccaagtatttccacccattctgtaggttatctttttactttcttgacagtgtcctttcatgcacaaaggtttttaattttgatgagttcacttgaagtttttctttttgttgcttgtgcatttggtgtcatctaagaattcattgccaaattcaaagtaatgagatttactcatgtattcttagactttttttgtagttttagctcttatattcaggtcaattcattttgagtttatttttgtatatggtttacagtgtgaagtaggatatcacaaaagaatgtgatatccattcttttgaatgtggatatccagttgcctcagtttcttcatctgcaaaatagggataagattgtgaggataggctactctgggcacattgcctatgggtcactgttccctgctctgcaaggaacagtatttaaattaacaaaaaaaattgtaaggatattttttcttctaggtttcttttctttcgttttgaaaaaatatagtctctttgttgaagaaactgttctttccccattgaatgatcttggcatctgtgttgaaaatcagttgaatgtagatatttgggtttattttttggctctgaattctcttccattggtctgtatgtctgtcctgtataaactgtactgttttgattactatagctttgtatagtaaattttgaaattggaaagtatttaactttatttttctttttcaatattattttggctctttggggccctttgaaattccatgtgaatgtgaggattggcttttctatttctgaaaaaagaaaaagcctgttggaattttgatagggattgcattgaatctgtatattgctttgggtagtattgccatcttaacaatattgtcttctaatccatgcacacaggatgtttttgcatttatgtagatctctaatttctttaaacaatgttttgtagtatacaagcccttcacccccttggttaagtatttttttggaggcttttgtaaatgctttttttttttttttttaagagctagggtcttgctctgtcactgggctggactgcagtggcaccatcatagcttcaatttcttgagctcaggtgattctgccatttcggcctcctgagtagctgggacttcaggcacacgcaacgactcctggctaattaaaaaacattttttgtggagaccagatctcactatgttgcccaggctcgtctcaaactccagacttaagcctgcctcagcctcccaaagtgctaggattttacaggtgggagccactgtgctggtgtttaatagccatgttgaggtaaaactgatgtactacatgattcatccatttaaagcatacagttcagttggttttagtatgttcagagttgtgcatccatcaccatactcaggtttttttttttgttttttttttttttttttcgagacggagtttcgctcttgttgcccaggctggagtgcaatggtgtgatctcggctcacggcaacctctgcctcccaggttcaaggagtctcctgcctcagcctcccaagtagtgggattataggcatgcaccaccatgcctggctaattttgtatttttagtagagatggggtttctccatgttggtcaggctggtctccaactcccgacctcaggtgatccgctcgcctcggcctcccaaagtgccgggattacaggtgtgcgccaccgtgccgggccctacttttcatctctgtagatttgcctgttctgggcattttatataaatggagtcataatgatacgtggtcctttgtgactggcttctttcacttagcataagttacggtccctccacatggcagcatgtctcagtacttcgtttctttttatgactgaatagttttccgttgtatgaatctgctacattttgtttatccattcgttgttgatggacattagggtcgtttccactcgatggctgttatgaataatgctgttgaggacatttgtgtgtaagtttttgtgtggatgtgtttcaccatctccttttaatccttagcagctctctgatgagtgggttcgtgtgtgtgtgtgtgtgtgtgtgtgtgtgtgtgtttgtgtgcatagggtgcttggatattcatggtgaagaacagttggaaagagtcaaggggcgctgggagggtgtggcagcagtgccaccctgcctggcacagaagtgttttggcattggagctacctgcacagctgtattggtgaatcccagcccatgggatttggccttacagggccacagggcatgtgtgtttggaagcctgggcctcccctgggactaggccaggagctggcacagacagcttgctccttgccacacgctgaggcaactggtgccccagggcactgctgctggcaccttcctgccaggcatgacctgtggatcacccgggctcagcccagtgccccagcctgcgtcagcaggggccacctggagggctcctctgggagaggcattctcgtgtgtcccccgcacctccccgccccgtggtaccccttgtgagtcaccgtcacactgggcctcctgccgcctacctgggacatcactcaaccttgtcctaacctctctccctcccttcctgcctcatttcaggtgaatacatcaagacctggaggccacggtacttcctgctgaagagcgacggctccttcattgggtacaaggagaggcccgaggcccctgatcagactctaccccccttaaacaacttctccgtagcaggtgtgtcttgggatgagtgggtcagtgttctggtgctcacaggatggctggcacgtcttaggggcttgtgggacttggtcattgagccatgggcctgtcctgggcctgcttgcccttggatctgttttcacccttcccctgctctccctccttgttagctggccaggcggggctgtcctgcggggagatgcagagtgggagggagggagaagccagggcatttgcccacacccagccccatgcatcgcctccttgtggttccagcttctgtcagccaggccttggagtccccaactggtggcaggtgcctcccatcctgtgctttggtaacagcctccatcctctgtccctcggacgtagaggggtcacagcttcccactcagctggtcacagggctggcctcgcgtcctctgtccctctgtaatacccaaagggatgtcttccagccagaccctggcagtgaagtttcacaagccccaagctcttgactgagccttggagaatatggtcctgtccacatcgctgcccctttctgccgccttccttccttgctgacctgatgggtcaccatgtcctgttgttctgcctgctaagaacattacagaggcacccccatctccactgccagtgccttagctcagaccactatcctctcctgccatgctgtggaacccagtccccgtcccacgctgctctgcatgaagccttttcctgattgctctccacatgtgctggtgaccctgacacatctgttcccaacctcagtgtctcactagaactcccagcctgtcccaggctgctccttggacacatctccccaagtgtcttcaaggtcctcataagtgccacatcccaacctgaccttcaggcctctcccagctctattcctgtctctgtctcagggacagcaggccgagaggcctgggcctggtcctcagtgccctcttcccatggcctgtctgcagggctccactctggtgtggccccatcctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctggtgggcttctctccttccacacacacacacactagaccctgagccctgtgagaacaggaccagggctgtctcagtccctagagtgtccccagcaccatctagcatggggctaggcctgtgggaggtggctcgggcactttgggctgcaggctagcagggctatcccctcagccccctgctgtctgttccctctgcctgcagaatgccagctgatgaagaccgagaggccgcgacccaacacctttgtcatacgctgcctgcagtggaccacagtcatcgagaggaccttccacgtggattctccagacgagaggtcagtctgggcctctgtgtggctgcccttgagagggagcaagcctggtgtgaggagaaaaggtacagctggagagattttccctgggaccctacataggggtttcctatctgcgcttctggttggggggtctctccagctggggctgagaagagctggggttcttagtctgaagaccctactctgccctttgacttgcgggtgcatcggaatcacaggcagagctcgtgaaatgtctagaccgctgggcctcgcctcaagacctgtgactacctggagatctgcccagggtcagggagctacattcttttttttttttctgaaatggagtttcgctcttattgcccaagttggaatgcagtggcatgatcttggctcactgcaacctccaacctccacctcctgggttcaagcgattttcctgcctcagcctcccaagtagctgggattacaggcgtgtgccaccatgcccggcttagtttttgtatttttagtagaaaaggggcttctccatattagccaggctggtctcaaactcctgacctcaggtgatccgcctgcctcggcctcccaaaatgctgggattacaggtgcaagccaccacacctgaccccctttttttttttttttgagacagagtcttgctctgttgcccaggctggagtgtagtggtgccatctcagtttactgcaacctccgcctcccgggttcaagtgattctcctgcctcagcctcccaagtagctgggattacaggcacgtgccaccacatctggctaatttttgtatttttagtagagacaggatttcgccatgttggccacactggtctcgaacttttggccttaggtgatctccctcggcctccaaagtgctgagattacaggtgtgagccaccctgcccggcaggacctacattcttaatgagcatctctattgattttgaggcaggtggtccagagagtcattttaaaaagatcaatttagtaatcagaagagatgataaagactcatctatttcaaaattgaaacagtataaggaggtgtctagtgggagcttcccctaccctgccctttccatccacctccctgccccccagttaatcactgttcttaggtgccctcaaagagcagagggagacctttgtgcctggctgcctttttttttttttttttaaatacaaaaggtagcattgtacatgcttctggacttgctttttcccttagtgtaccttggggaatttgccttgatatatggagagatgcagctgctttgtttcatgttttgcttttttttttggacagttggacatgcgtgtcccaagtgtgtttatttagccgttctttattgtgatgactggggttgtttccagcctttggctcattataaggaatgctgcagtgaaatagccgtgtctgtctcgtttgatgtgtgcacaggtagacctgtgtgacgagtgcttagatgcaggattgccgaggcacagggaaaataagtttgtggttttgcgatgtttctattaggcgatgtctgagagtgcccccatggccttgtgttttcaaacatttggatttgtaccagtctgagcagtggaaaaattcagcacctcggggtgtttaactttcctttctttctctgtggatgagtttgaccctcaagggccatgtgagttcctattctgaagtgtctatattgtctatttttctgttgggtagttggtctttttcttatttatgtattagctctttatagattaaggagctttgccctttgtaatcagtgggaaatgtttctttttcccactttgtccttttgggcctcactttgagaaacagtcttctagcttatctatggggtaaggtttcagcagaccctctagagagccctaaaatcatgccgtccaagaaaacttccggccattgtggaaatgccctttatctgcactgtccagtaggcacctgtgccaattgcctgtgccgattgcctgtgctgactgcttgtgccgattgagcatttgaaatacagccaccaaggaatggattttttctagtttattttaattgatttaaagagccacatatggctagtggctaccttcttggacagtacagctcaggaacccacaatatcatgagacttgttactataatctatactataattattgttgcacatcctcccaaggtaaaaaatatacttgccccactgaggggaacaaaattaccatctcaagccagctgaggtgctactcagttgaaaactatggaccaaaacatgaatggccagtaaaaacagatcgagaccagtgggtgtataggtcctgggtgttgagctgggttttgaagactggataggatttggccacggagatagcaaggagaaagttcagaagggacagcatatgcaaagacctggaggtgaaatagctcatgcattccagagactacagggggttctgtgtcaccagagaaccaaggggccaggagtgttggaagaggggaagtggaggcgctcgaagctggagagctcagccaaggccttggactccaggtggagatccccacagggcttggcaggcacttagtaaattgcggtttgtcccagggtagttacacgatgcaggggaatgataaataggagcggctgatgcagcagtacctggcacatcaggtactgacaaggtggagctgacaaggtgttttagtaggcaggagagatggtctcgtttccattttcacaagacaacatgccctttcctttaccaagattctgtaggctggagagccccacctgccttttcttcttggtacctgctgctgttgccaaagagaaaactgctggaacgactaagagaccaggtcccagatttctgaccttaactatgggtgggtggagggggtgaaccagaaacccagcaagagggaggccccctccactctgctcctggctgactgatgctgtcctcacagccctggcccacacaggctgatgtcagctggcctctcttaagcctggggagggaggcaggggttgcagggcaggtgggtgccagtcggtgactgcttgttggctaggtgctgcagcgcctcctcactgggctcctggttgcctctccagctggagagaccctcctccctgtcccccacttcactgcagacgtgtttcacatggagaaaagttgaaagaatagtataatgaatggacatccacgcgccccactcctagactctgcagtcccgcattcaccgtgtctgcttcatctggttgtgttttatgctgaacttgaacttgtgttcatacttagtgacattcttagtgtttcagcaggcatctcctaagaataaggactttctcctacagaatcatgatgctgtcacgcctgagatgattataatctttgtttactagtaacttctccttatccatgccgtacttgaatttctttagttaccttttgaaggatatgcaacctttagaacattgttttaaaaccagtattcattcaaggtacatgtctctttgacttgttttatttaatctagttcagccctttgtctttttttttcctccccaagacattgattttttattaatttatttatttttttgacaagccaggctagttgtcttgtagaatgtcacaccttctgggtgtgtcatattattgccttttggtgttgtttacttttgttccccatgtttgtatttcttgtaaactagaattaggccaggaacagggttggcaaactatggccctgccttccatttttgtaaataaagttttattggaacatgaccatgtccatttgttcatgaatagtctggctgcttttggcttactgtggctgggttaagtagttgtgacaaagactgtcttgcaaagcctaaaaaatttaataattggcccttttaaaattttaattaaaattttttaaatttaaaactttttttttagagacaagttcttgctctcttgcccaggctggagtgcagcggtgcaatcatagctcactgcagtctcaaactcctgagcttaatccatccttacgcctcaggatcctgagtagctgggactaaaggtatgcaccaccatgcctggcgaatttttaaatttttttgtggagacagagtcttgctatgttgtccaggccggtctggaactcctggtctcaagcaatcctccctcctccacctcccaaagtgctgggattataggcacaaaccaccacacccagctttctggtccttgatggaaaaagtttgcagacccctggtcttggcaggcaagaatacttaatagtgcatcaggtgagtatgatctttttgttgttgttttgatggggtctctgttgcccaggctgcagtgcagtggcagaatcacgactcactgcagcctcaatctcccggatttaggtgatcctcccaccccagcctccctagtagctagaactacaggcgcctgccaccacaccaggctaatttttgtattttttgtagagatggggtttcaccatgttgcccaggctggtcttgaacccctgggctcaagtgatctgcccatcttaacctcccagagtgctaagattacagccatgagccactgtgcctggccatctgtgatctttttgacgtaaatctttctttcttttttttttagacagagtttcactcttgttgcccaggctggagtacaatggtgcaatcttggttcactgcaacatcttcctcctgggttcaagtgattctcacgcctcagcctcctgagtagctgggattacaggcacgcgccaccatgcctagctcattttgtatttttagtagagatggggtttctctcatgttggtcaggctggtctcgaactcctgacctcaggtgatctgcccgcctcggcctcccaaaatgctgggattacaagcgtgagccaccgtgcctggccttgatgtaaatcttatcatgtattttctctgcttagaactctgaatggctttcactcccactcagagtaaactccaaggtccgtgctgtgtcctgcagagtcctgtatgatccagcgacctctccagaagcatttcctaccacaagcaccctcacttagccacgtgtctccttgctgttccttaaacatgcctagcacatctcttgcccgagggcctcagcgcttgctgtcgcgtttgtctaaggccttcctccctgagatgccatcacagctctccccgactccacgaggtctctgccccagtgttgccaccccagtgcgtcctgccctgcctcccttcgctgtcttgcccttccccagctgtgcttttcttcatagcacctgtccaccaagtgggacatttatatttatgtatgtatctggcacacaaatgggtgttcagtaaatgtttgttggataaataaaaaataattaaattctctgagctagatcctgttccgaggacttttcatatattaatttattttctcctcacaaggcagactatctgtgcacagggagggccccagatgccctccagctgtaaatgcccctctaggtcggggaggtgatggttaggggagagtccccacagtcagctgtcactcctgaagcggtgaggacgggcttgtgcatgaaggacagccctgccacctctgcttcgccgagcttctctctggggtgccccgcaggatggcccagggctggggtccaggccctggattcaggccagctgccgtgtctctccctcagtggggctcagttccctggctgtcatgtggtgtagaggaggaagtaaacatgaaggcactggcgcagggcctgcccatggcagctttggcacacgcagcactggtacctttcttacctctgtctcctctgccaccagcatctctttcctggaggatgccggggtctcctctcactgcccccagtccgtagcccacacagcagctactgacttaaaacagaaatttggagcctgttcccccctgactaaaacccttcagcgacttcctgtggtgctgaggataagacccagatctctaacatggtggcacgtagaggccggagcggtctgggcatgctctcctccctgtcctcatctcctccactcctccctgtcctcatctcctccactcctccctgtcctcatctcctccactcctccctgtcctcatctcctgcactcctctctctcctcatctcctccactcctccctgtcctcatctcctccactcctccctgtcctcatctcctgcactcctctctctcctcatctcctccactcctccctgtcctcatctcctccactcctccctgtcctcatctcctgcactcctctctgtcctcatctcctccactcctccctgtcctcatctcctccactcctccctgtcctcatctcctccactcctccctgtcctcatctcctgcactcctctctgtcctcatctcctccactcctctctgttggctccagccattctggcacctgtgtgcctttcacagacaccccagcttgctcctgccctggggtctttgccatgcagttccctctgcctgggttcctttccctcccaatcccctgcctccttccctccatttcatttatttcatagctgtgtgccaagggcctgttctaggcactggggatggccattgttcaggtcctggtttaaacgtcatctcctcaggcctcccctgactgccctctgagaaggagtctccctgtttggcccccgccttggagcttctacacacttgtcctccccttgaggtcaggagccatgatgggcttgtcccctgctgcatccacagtgccctgaacaagcctggtgcacagaaatgctccacatttgcaggccggctgggtgaactctcatgacagccttctgagacctcaatgtgctgggcaccgctctcagcactttatgtctagtgtctcatttcaccctgataggaccctctagtgcctcacccaccgaggcacaggaagggcatacaacctgcccagtgttgcctgcaggaaggggcagagctgggatccacgtccaggccatcccccagagcctgtcctctcacccactgtgaggtccccagctggtacggaaggcaggcagcgcattgggtggcaatgaccccacagctcctggcccagagcctgtgcttgccccgtactgtgcccttcccagtgttggtatggcgaacgtggctcccccatgtccctcccctggccctgagcccaaatgaggatgagaaggttccagaaaataccgatgggggaagtgctcttggaggtagaagtgcctgggcacttcttgtgtccctggcctctgtcggtgggcagatgagcctctctgtgcttcggtcttgtcattttagcatgaagtgaatggcagtacctactacacagggttgctgggagggcgacaggagtcctccaccataacgcacagtggtaccagcctctgcaagtggaaggtgttcttgggactgctgttgagtggcaggggtgggggcccctctctgaaaagcgggtgcagatcatggcttacgaggagagttcttcctttgcttttcccgtgggctccctggctgggtgtcccatgagccttccctagagagggtccctgctttaccctcctgagtctcgtgtagctttcagcgcttcactgaggctcagggacaggcgggtggtgctaaggaggagtaggctgtgcacaggtgagtgccagctctgccacatccctgctgtgtgaccttcacaggtgactccacctccatgtgcctcagtccccacagcagaaatgctggctcttgagaattgcagtgctcttgagaatcaagcgaggtggtgtctggagctagccactcagtgctgttatttttacagtcgtggtttacccaggggctctcctctgggggctagaagatacttgaggcccagcttcatggggagctcccctttgccccagacgccatgttgcaaacccttgagaaggatcctggacagaggcccttgcttttcatctggaattctgagtgctgcaaccttgcaactttggtccagttagaattggatcggaagctagtcaggcagcaggcgagccccagttactcccagataacctcctgcattgctgtggtttctggagctttctgtagggtgggcagtgggagccagggtaggtggggtaggcccgcccctgcgagtgtcttcggcaccctcccttccaccccgccctgcgcgcggtgctctgcgccgacagcccgccaacctcttagccccaggcccaggccctggtggaggggagagctgggagggctgagctggtccaggtggcagagccactcttggagccccagctggggtgggtccagggcctgtgctcctgattcccatctggagtagcctcccagagctgcttctgggctggtggtgtggcagtgccatccttcatgtatttgggttctctccacagagggaccatctgtgttctctccacccctgtctttgaaaacaaagatgataccacgctgtacatcttagtctgcaatctgccatcttcacgtgacagtctctcaagatctttatatatgagagacatattttcctttttaatatcttcactgtatctcttaggagatctgtgattttttttttcccaatccgccatcatttactcagagtcagcattaaaaaaatttaaaatttgtgagaggacaactatgtctgataaagcatgtcatggaaggctgggcacagcagctcacacctgtaatcccagcacttggggagaccgaggcaggcagatcatgaggtcaagagatcgagaccatcctggccaacatggtgaaaccctgtctctactaaaaatacaaaaattatggtggcgggtgcctgtagttccagctactctggaggctgaggcaggagaatcgcttaaacctgggagccactgcactccagcctggcagcaaagcgagactctgtctccaaaaacaaaaagaaacaaaaaagaaaaaagcctgtcatggaatgggctcctgccctgtccccggcccctgcttttttttttttttttttttgaaaaacaggaatattagtgtagggtttgggaattaggctgtaatttgttcctaagggggcatgggttaaagcaagttgagaaatactggcttgagatgttgggccagggagtgcagaagccaacaccgctctgcccgggtgtgcaccagggctcagtgcgtgctctgcccgggtctgcactgggccctgctgcgccctggccctggggccacttggactttggctgcctcactctttcattacccaagtatctactgagtatccaccatgagttctgggggcagaactgtgttcaaagcaggtggaaatctctgcctccgtggggtggacatagatgggttatggggactccagtctctgagtgggtggggagggcagcgtgccttttgtaattccagctaccaagcctggagcaactgctgtttttctggaatctgttttttcaatctgtgccccagttcctccttcataatgggtgggagtagggatagttgatgatagcaagtgcttcccatttgttattagaggctgttcctttccttcgactcccagttcccctcccttggaggcaggcagggctccaggatcatgacttctcttctggagatgtttgtgcctatgtgagcatgtgtctgcagaagttcattattttctaacttaggagcacagaactgtatactgttcttcaccttccttaattttgaaattttttataaaggcgtggtcttcttatgttgtctaggctggtctggaattcctgggctcaagcagtcctccagcctctgcctcctaaattgcagggattacatgagtgagctaccttgcccatccctgcaccttcctttttctcttaagaagtctcagatcatcccaagtcagcatacagacctgcctcaatctttcccccagctgcagaatgtctcattgcacagatgcctcacaggcattctacctcacgacagcctgtgtattaaacactgctgtgatatttcatcaaatcgaaggcgctgtcattggggaggcaccctgtttcatatagtgccaagaaaaaggcgtgcccagttaaatcaagacagaccccaactgtgagattaatctgcattccagcagtgtcaaaatgtggaagagggtgcgttgtgggatggatggaaatagaagtagtttcgcgtggtacaccaggaaacgagactggggaggaatacagcccagcagggtgtcccggcttggattttgaagcccagtcccagccacacttgttccctgcctgaccttgggtaggggccccagtgtctcaggaacacaggagcagtgacacttgccctggggcgggggccatcctggaagatgctgtgaagggctggctgcactccctgtggcttatttaaatcactgggatttgcgtgattacactctctgaattttctcattcttagtgaacattttatttttcttgttggtcatatgagtattttctagatacaagcaaaatacacggggggttcaaaatgcgttgggttgaaacacctaattgcagtgtggtcaaaaatgggggatgtggacaatttggtgtaattcagcctaatatatttttcattttggtctctggtcattttcacttattagacagaacagtttgtaagtatccaaagaaaattattttgttttttttttagctgattgcagtggtatgatcatggctcactgcagcctccacctcctgggctcaagcagttctcccaccttagccccctgagtagctgagaccacaggcatgtgcccccacacctggctaattttttatctttggtctctacaaagtgggtatccatgttgcctaggctggtctcaaacttccggatgcaagccatcgtcccgtctcagtctcccaaagtgccaggattgcaggtgtgagccaccgagcccagctcaaagacagttctttctcagcaagttctaaaccatgagtgacagaactagtttattgttctttattttattattattattattattattattattattattattttattattattttgggatggagtctcgcactgttgtccaggctggagtgcagtggcgcgatctcggctcactgcaacctccgcctcccgggttcaaatgatcctcttgcctcagcctcccgagtagctgggattacaggcgcccgtcaccacgcccggctaattttttgtatttttagtagagactgggttttactatgttggccaggctggtctcgaactcctgacctcaagtgatcctccaccttggcctcccaaagtgctgggattacaggcgtgagccatcgcacctggcctgtttttattttttatttttgttttttaaaaactttttaagagatgggtcttgctttgttacctaggctggtcttgaacgcttcggctcaagcacttggtccaccttggcctcccaaaatgctgggattacaggtgtgagccacagtgcttagcctctagttaactgttcttaaaccaggctcccttctgctgggacctacttcttgtccaccagcttctctcctctacatccctgggctgccaggacctctgtccctgccatgcagactccctgctcccagtggactgtcccctccagggagtcctgcgggccagctcttgccttgcagtgtcttcagctcctttggctaatgaatgctgcttcttactcttggtttaactttacaaaacattggtaacttataaacttgagcttgtcatttgttccgaagaattcacaggagcactctctctccctcattcaaggctcagggtggtggctcattttcaaggggctgtgaaaagagagggtcactcctttttgatcatttccctgctgcctggcttcaaatggccctcaggccaggtcactttagggaaattggtgatcgctcttggtattccactttttttttttttttgagacggagtctcgcactgtcaccaggctggagtgcagtggtgcgatctctgctcactgcaccctccgcctcccgggttcaagcaattctcctgcctcagcctcctgagtagctgggattaggcgaatgccacccctgactaatttttgtatttttagtagagacggggtttcaccatgttggccaggctggtctcgaactcctgaccttgtgatccatccgcctcagcctcccaaagtgctgggattataggcatgagccactgcgcctggcgtggaatttcactcaggtcccttcagctctctctggttctgacagatcttgcccaaattcccatggttatgtggtcatttgcttgcctgttgctgggggtggctgggaggtggcactcagctgttcgactctgaggcccaggactcctggctgctgggactcacgtgtgtccctgcacagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtggtaagtgctgggagcaggggtggggctgccagcctgcggtgcccccacccccagtgctggcctgctctccttggtttccataacacagttcagggggctcagctgagagacaaggctgccctgcagggtggggtgatttcaggtggcaggtgccctagggtgtgctccatgcccgtaggggagggagcaaccttgggtggacccactgcaggttcgtcctgggagttggtgaagacctggctacccccacgtcagagcccagccctcccaaggccctgtgcctgcagagcctggtctgaaggccgcttcagaacacacagttgctgcccagagcctcccttcctgctccagcctaagccgtttggcaacagtgtcttttggttttcctctttcttttgttaaaatttcctcccacgggccatgagccaggcgctgactgcccccactctccctgtccctggcagaccatgaatgacttcgactatctcaaactccttggcaagggaacctttggcaaagtcatcctggtgcgggagaaggccactggccgctactacgccatgaagatcctgcggaaggaagtcatcattgccaaggtgcgtgccccgggaattgcgctcgcgagcctctgtgggggctgcggtctggagcctgaccctgaggcctggacgcttacccgcgctttctgctgctgtgggcttatttcccccacaaattccccctagtcagaaaagggggagcctgaggcccagagaggagcagcaggccttgctgctgagtccccacctccaccctatgttaggggctgggggtgcctgtggagagagagagcctcggggccccacccagcaggtactgtcaagggaggctggggcctgttggggaggacgtcgctgttggggagtcccgggctttgctcagggtatcccaggtggaggccgggccaggagtggaattctactttttcccttatttgaattttttgtagtggaagattccaaagacattcaaaaatttaaaaagaaaataaatattacggacccccatgtagccattgtccagtttaaccagttatcagcgtttagccagccttgtttccttagctctgcctgtccctcttgttctggaatactttaaggcctgtcctagacaacacgtcacttcactcatccatacttgaacatgtgtcctgacagatgaagactgtaaagaatataatcatgtggtgctgccatcagagccaaccaaattagctgttcattcctgatgtgacgattgggcctaaggcagccttcctcagcctcagcactgttaacgttttgggacagatgattctgcgctgtcggggcagccctgtgcattctagggtttcagcagcacccctggcttctacccactgaagccaatactagctccccaagttgtgacaatcaaaaatgacttttgggttgggcgccacagctcacgcctgtaattccagcactttagaaggctgaggtgggaggatcgcttgagcccaggagttcgagaccagcctgggcaacaaagcaagaccctgtctctgtaaaaataaaaataaattagctgggcatagtggcgtgcacctgtagtcccagctgctcaggaggctgaagtgggaggatcagtggagcctcagaggttgaggctgtagtgacccatgttcacaccactgcactccagcctgggcgacagagccagacccccagctaaaaaaaaaaagggaaaaaaaaaaaaaagacttcagacattctcaggtgtcccctggggataaacttgccccagagagagcctgtgttcacgttgctgcaggtggctccagatttttggaaccactcctggtggttctgctgtacagtcaggtaccaaattagaacctgaattagagtcacccaaagggcttgtgagacagtgctgggcccaccccgagtttctgactcagtgggcctgggggtaggtcccaggaatttgcattgctgccagttcccaggcggtgctgaggtgctgtgtggggaccacaccaagaagcactgtttttccttctttgggcaagaatgctttctaggtgggacttcccacagcctgtggtggcacctcggggctctcgtgatgtctgtttgtctcccttgcagggacgtcacaggtgtcttgtccctagcagcctggtccttacattgtgacattcctgctgacttttcacctgtggctttgagagccactgatgatcctcgtctgggtctgctatttgctgagggtttgcaggctttcacttttcactcctgtgattttctgcatttatggctgggaatggaattgcatttcacaaggccttgctccccttcgtcggggcggagtgggcaggtgtggtgttgcccaccagcccctcacccgcagtctgtctgcaggatgaagtcgctcacacagtcaccgagagccgggtcctccagaacaccaggcacccgttcctcactgtgagttgccctccccttcccagacagtgtgaggccagcctttggacagagctcagagagagagccctaatcttctggtacaaagcacagtcttggggtaggccaggcgggcagggcaaggtgttgctgcgccctgccaagtcatccgaaccaagacatgtggtgggggtgagcaggctcggggagtgggagggtgacagcttcttcatagatggtggcttcatgtaagcatttgaactaactgaagatatcacattatttgctggctgctgtctctatgagttaggagcacttagcccagctggttgaagtggaaacattattttttttgtttttgttttcagatatgctcatagaagcagatgtgttagcattgtgttgtctgtcagcctggactgagtagatgcctgtttgggctgcagtctccatcaaggccagtggccaccagttaaatggactagattgaggatggcttatgtatcatttctttatctcagttgctgtccaggtatcctattaagccacagtactttttcaaataaaatcttatgaggtacctcagtgcagaaaacagaatagttgagttgtcatgagctgaaggaccccctggtgggagtctctgaggaactctctgtagatctccttagtgcagtggagaactactgtttgttgactgacagcctgtccatcctgtcattgaagttggctcccaagcctttgccactcccagccacagcagacatcacttgtgtgtgtaagttgaacacattttactgtaaaaacaagagccatggttgctcagaacagctctagttctcccttggctgtgcctgatggaggcagaggacaagatggttcagcatgtaaccctttcctaccgcagagccatgccttcacttaatgccccaaaaggtgcagccggtatgtgaaccccatatggctgactcctgggggccccagccagggcagggtgtgtgtgtgcagaataagcagggccagggccctgccctggcatggctcagcagagccctcctccctcccacctcccaccctgctgccttcatcccccaggcgctgaagtatgccttccagacccacgaccgcctgtgctttgtgatggagtatgccaacgggggtgaggtgagccgcggctgccttgactttgccctctggggcctccttctttagggtggggcgggatggagaggagctgtgggtgagatggaagggtggagggaaatttcagtgtcatctagtgcccctctcccttgaggcaggcggcttcgtctccattttgggggggcagtcactgaggctcagagaggttaagtggcttgcccaagtttacacagctagtgagtgggtgggtcaggtccaaaccagtccagagaggtgtggagagggctgtggggcgatagcactgggaaggatggtcttaaaggccccagagaaagcccccaagggttaaaacctagcagccctccgttcccgtgtcctctcgaagtgaattcccgcagccgctcagcttccccttacagagtcgcctcacttttgtcacccactccttgcctcgcgccttctctgtgcagtggttggcacacctgctttgggatgcgtggtttgctcatctgtctgatctgggcttgcccatggcctattgttacttggtcatgacgtgtgcttctttttgcctccatgccatcctccctcctgtctcggatgtctctcccataccctctcatgggtgcctcctggcagaccctcgcccttccccccagctctgtgtcacttatgagcttctgcgctctgccttgattggtccctctagctgtcacttgctggttcatgatacaggtgtcaccacatcactgcgctggggcagggggctgggaaggtgagggcaggtgggtgggctggggcctgacctcctctccccaccccttcctcctgcagctgttcttccacctgtcccgggagcgtgtcttcacagaggagcgggcccggttttatggtgcagagattgtctcggctcttgagtacttgcactcgcgggacgtggtataccgcgacatcaaggttagtggcagggtgtgcgccaggctgacctgtggcatgcacaccacatgggactcacactggggaagttgggctgagcttctgccctcattcgccaggctccccaccaaggtccagggtggtggctgccctcattcgccaggctccccaccaaggtccagggtggtggctgccctcattcaccaggctccccaccaaggtccagggtggtggctctgtggcaagttgccccaagtagggaccttcccaagcctcccatgagcgctcctaggccactagcggagtgtcaactgccacaatacctactttatttgtatttatttatttatttatttttgaggagtcttactctgttgagtgcagtggtgtgatctcggctcgctgcaacctctgcctcccgggttcaagcgattgtcctgcctcagcctcccgaataggtgggattacaggtgcccgccaccatgcccagctaatttttgtatttttagtagagacggggtttcatcatattggccaggctggtctcaaactcctgaccttgtgatccacccacctcagcctcccaaagtgcttggattacaggcatgagcccccgcgcccggccaattttagaagatagtttggcagtgtccaccaaagctgagcaccagtcatctgccctagctgtgtgcacaggagaagtggggacacacactcaccttagaaagtgtccccctcactcagcagcaggacttactctagccccaactggaacaacccaagtatccactgtgagaggaacagtcagatccactgtggagtgttctcacagtgggacgccacacagcagttaggaatgagctacagctacacacgacagtgtggacgcgtctcataggctaatgtcgagggaaagccgcacagaggaggtgagtccacagttcacaggtgtgtctgtgtgcagtggtacagatgggaagtagaggttaattcttgtgggggatggtcagtaaccgggaggggcacacagggccttccagggggagatgccacctcagcctcgcaagtagctgggactataggtgtgtgccaccatgcctggctaattttttttttcatattaagaaatatggagatggggtctcgctgtgttgcccaggctggtctcaaactcatgggttcaagcaatcctgccacctaagtcccccaaattgctgggattacaggtgtgagccactttgcctggctgcatatttcataattaaaggacagaaagtctagaaaaaaagaatagaagaaagctagtgcccccacgttcgaaataagaaccacagttcacaatggggacggtgggtggacagggcctggctctcggctctccctgcccagctgttcccaggtaccatgggggtgggccagagggtgaggagggttggatctggcctctctctgagcctcagagggtgaggctgtgtgtgctgggcccagcctggcatgggagggttgatgtccaggagccccgggcatctttccctggaaggaaaggctggggtggcaggaagccttgggagcatgcacctgagatccgttgacttttccaacagctggaaaacctcatgctggacaaagatggccacatcaagatcactgactttggcctctgcaaagagggcatcagtgacggggccaccatgaaaaccttctgtgggaccccggagtacctggcgcctgaggtgtctggggttggtgggggtaggaacgtgtgaggccaagggtagggggatcccccagacctgtgtgtttccagcccagatgccctgagggcaggactgtgatgccagcctcagggccacgggcccagccctcatttctcctccatcctcaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggtgagggctggcgtcggccccacccagcccagcgccagctgctgccactgtccctgcggcctggagggggcagcgtccacaagggtgctcgcttgtagggtcgcagtgtgtcgtccccacacagcccctgaaaacgtccacagtggcacttagggagtgcttcccccagggcaggcccatccttgacactgccttattttatggggacactgaggaacagggcatcccctgggcctggctggggccaccaaaccatatgtggcagagccaggataggaacggagcctgccctactaactccctttctggactcagggtaaggccaggcagtgaggacacgtgggtccgggttgctgactccctggctctgaccctgggcacgtgagctccctccctgagcctcggtttcctcctctgtgaagtggtttgtggtcaagacagaatcattaagggccatacagggcctgcctgctccgaaagcccgtctgcccgaacccagctgctccgggaggcaggtgctgacggccgtctctgcacaggcttggtggggggcccagcgatgccaaggaggtcatggagcacaggttcttcctcagcatcaactggcaggacgtggtccagaagaaggtgagccccactgcttgccccagcaggaccctcagggacctggcccactcgtggtgaccttggttgaggcctcctggcctcagggtccctgagcctgagctcctctcctccgtagctcctgccacccttcaaacctcaggtcacgtccgaggtcgacacaaggtacttcgatgatgaatttaccgcccagtccatcacaatcacaccccctgaccgctgtgagtgcctggggcccccgcgctggtgtgcctgccccaggggtggagggatgggatctgctcttaactcacttctcaaggagggccctcgaaggcccccgcttcatgtctgggagatttccccaagtctgctctcaggcccttttgctgttggtcctctttggacctggtgaggccaccaggagccattgactgcagcacgttctggagctcagtcggggggctcagggcaggaggcagcccggtccctgagcctggctgggttcactgctttacagctgtttgggttcttactctgaactcagcccagggctgggctatgctggggacacagcactgattgagccagccctgggccctgccctggaaagctcccagcccaggtagggtgggcggcctggagtggtcagggctagggcgtgggaggccagggactggggaatcccagaggaaatatccgacctggcctgcagttagggagggctttctagaggaggaagcaaacgtgtcagctggccggaggaatgacgtgtgggatgccagcaatgggagaagcatggcatagctaaggaccggcagcagccagggagatggtggtgagaagagagggcatggggctggagtgcaagggtctgggggccactgggaggggtggggactgcttgcatggcgggagccagccatggaagggtttcatacagagagggacagggttaaagcaggcctttagaaagcccccctggctgcccgtggagaatggatgggagggtgcgagaggcaggccaggacagggctctgggctggactctggcatggtggtgtgtggggcagagagaaggtgggaggctcagaaggccctgccagctgtggggcgcatgggcaagggcacaggaaactcccagaggaggccgcccggggctcaggtttggggagtgggtccgtggctgagggcctccattgcggagggatgggcctttcctgtcctgtcctgtgggcagcccccgccagctggggccgtttccccagggagtctgggcaggtgtcccaggccctctcctgactggtcctccccatccacctctgccgcccacagatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgtactgtgctggtgcttttgtttgtctacatcccaggattttaatgtccagtacctttccaaaaaagtgtagccattcagatactttaaattttgaaataattgcagacttgcagaaaactttcaaaaatagtgctgtactaagattattccaggcctggggcaggaaatgtacaagatgagcctggggcatcttgcagtgcctgaaagcacgcactgatatgcttaagtcacagggacacaggagccaacagaaagcttccagtggccaaagctgaaaagaatttgaacaacaaaataaatagcataatattgggttttcacctaaaatgtgaaataagtctattgctaagtggcaaaatggggagaatatgcaaatctacacaaaatcataagtaatttctgtagacagccttcaaggagggctatggaacccccacttcttaggcgtgggctgcagtgactcctccaaagagtgcagtgtggagagggggaaaagtaacttttcagtgaaggtccctggcaaacactacatcatccagccaatcgaggcaaacactgctgatgaatcaccttcacagtgtccctttaatgtgatagaatggcactttccctctgatcctcctcttgcagacacacaccacctcactgagaggaagcagacatcagacagatctcagttgagggatttgtctgccaaggtggttaatcagaaaattctgagaaagtgacacatccaagatcaaccaaaagagtcatggtgactaaatgtaatgtttcctgaaatagaaaaagaacgtagggaaaaaggaaggcttgaataaagcatggacttaatagatgaatattggtctaacggattgtgacaaatggggcacactaatatgagatgttcattggggaaattgggtgtggggtaggtgggaactgtcaatctattcaaaaaagttatgtagaagaattacaaaatatacccttcgccaggttcgtcatagcattttacttaaaacggacaaaaatgggatcagaatgttaaattcacccctccacctcccgctccacattgtatacctgtcctaaagaacattctgctacataactgctctccagttaccaaggtcaggaagctaacattgaaactgctcttctgtacagattttatagtgttcgctaatggtcacgcttaatgtccttgtatgttaaaaattcctagctaatgaccaggctcacatgttgcattcagttggcaggtgtgaaactcacagggcagttattttgcagttattttccctcaaccagggttggttgcctcactttttttttttctcttttttttaagacggagtctcactctatcgcccaggctggagtgccatggtgcgatattggctctctgcaacctctgcctccagggttcaagtgattctcctgtctcagcctcaccagtagctgagattacaggcacccaccaccacacccagctaatttttgtatttttagtagagacagggtttcactatgttggccaggctggtctcgaacttacctcaagtgatctgcctgcctcaccttcccaaagtgctgggattacaggcgtgagccactgcgcctggcctaaaagatatatatatatatatatatttttttttaaagctacttacgtctctccatttgcccgcaaggaaattccttgtggacagaagacaggcagagttcaaagtcatccctgtgctcacatgagaccaatgcatatctgatggcttcctccgtcctattgtttgacccagactaggcatggatggctcttcctgtaaattgtgcattcagtaaaaggctaatcaaactcaaaagaatgcagccgtttgtctcctgtctatgacctggaagccccctcccctgcttcgagttgtcttgcctttccggaccgaaccaatgtacagcttacacatattgaggacgtctcatgtctccataaaacgtataaaaccaagctgtgccccgaat

SEQ ID NO: 3 - DNA, 130014 bp, Homo sapiens
tttctctgtcactcaggctggagtccagcagcgcgatctcggctcactgcaacccctggctcccgggttcaagcaattctcttggtactcagccttctgagtagccgggactataggcatgcgccaccacacccagctaatttttgtatctttagtagagacagggtttcgccatgttggccaggctggtctcaaacacctgacctcaagtaatctgtctgccttggcctcccaaagcgctgggattataggcgtgaaccaccacactcagcctgatatttgtttacaggtttttcttttgatgtaaaatttacatacaatgaaatgcacaaatctttagcatatatttgctgcattttgacaagtgcttacccttgtgtgacccaaactcttatcaaggtatagaatatgaccgttaccccagaaagttcctttttctccttcccagttaatcttcaagcttccttccctgtattttacttgtttatttctttttattattattatttcaaattatttatttattttttgagatggaatctccctttgtctcccaggctggagagcagtggcacgatcttggctcactgcaacctccgcctcctgggttcaagtgattctcctgcctcagcctcctgagtcgctgggattacaggcatgcgccaccatgctcggctaatttttgtcttcttagtagagatggggtttcgcgatgttgcccaccttggttttgaactcctgacctcaggtgatccacccaccttggcctcccaaagtgctagaattacaggcatgagccactgtgcccagtcctttttttttttgttccagtgaagttagagcaacagaatacagagtatgtggacaggttgtgggtgtagttcttgcagaatagaatcctatacttccgtaatatgtttgtatttggtcagaccatggtattcactagcataaatggtagcatggtattcaccttttgtaatgacttagagtgaggtatttccattcttttactcttataaataatgttgtcatgaacattttcttataaatctttatacatatgcatgattattaatagtcaaaatagtaatattggccaggtgcggtggctcacgtctgtaattccagcactttgggagaccaaggcgggtggaccaccagaggccaggagttcaagacaagcctgggcaacatggtgaaaccccatctctactaaaattacaaaaaattagctgggcatggtgatgtgcgcctgtagtgccatctgcttgggaggctaagccatgagaataacgtgaacctggaggtaggggttgtagtgagctgagatcatgccactgtactccagcctgggcaacagagcaagactctgtctcaaaaaaaaaaattagtaacatcttcttttatctgaaccagatgaaactttggttctttaatggcatgaactggtcaaagtttctcacaggccctgtatttccaattaaattcagtgctcgaatgacatccagaaacctgcacagcttgcagctctctgcctgaagaggcaacatccgtcactgggtggcctggtcctgagcccttggcaatttgagggtgggcgttttgctcaaagacaattgctaaggctatatggaatatctggtgactgttccatccaaatagaggtgtctgaccttgtttctttcccagaggctgaaattggggtcctaaggtgaaatccagttgtaaattactttttctttatttggaatgtgaaatgaaaaatgtattcttgaggctgggtgcagtggctcacccttgtaatcccagcattttgggaggctgaggcaggcagatcacctaaggtcgggagttcgagaccagcctgaacaatatggtgaaaccccgtctctactaaaagtaaaaaattaaccaggtgtggtggcacatgcctgtaatcccagctactcgggaggctgaggcaggagaatcacttgtgcccaggaagcggaggttgcagtgagccgagatcgcgccattgcactccagcctgggcaacaagagcgaaacaccatctcaaaaaaaaaaaaaaatgtatttttagtctaaccattgacatatgtatcataaaaaacaagcaagctagatttctcaacaaaggttctctaagcaaggaatacacagacgttactctttctctgcagcctctttcaggatgggggactttgatattgccatacattcctcttagaaatcatcttaatttgttattttcatctactctagtgggaagataaaatcactacatggcagagccaggagtttcaggcccatttggggatttcctcaaggatatcttataaatgtaaatttgctggttattcatatgtattgcttaattgccttcccgtctccccagtgattatgccagctaccaccattattactaaaaaggttaactttttttaagcaattcatttttctgaactgtgtattagtttgctaagggatgtcatagcaaaagaaccaataaacaacataaatgtattttctcacagttatggaggctggaagtccaaggtgtaggcagagttggtgtcttttgaggacacactctgtggcttgtagatgatcatcttctcctagctctgtgtgtctgcatcctaatctctttataaagacaccagtcctattggattagggcccactcgtatgacctcattttactttaaagaccctatttccaaatatagtcccattctgagatgctgggggttaggactccaacatgtaaatttggtgagggagcagaatacaatttagtccataagaaatcataaaacacaaatatgtaagagaaatgtgagcataagaaaaagttaaaaagctcatacatagcttcctcagttggaacaaatcaaagtgctttcttgtttttgccatatgcacatctaattattggctcttactagtttacaataccaacagcaatgcaagtatatgtcagttttatcacaaactcagaattaggtattcttaaaaataagattagttatatttttattgtatttctcttttaattcagtttcccaatttcccttaatgaatttgctaggttgaaggttttcctatatatatataaatataactatatatatacatattttttttaatagatggagtcttgctctgtcacccaggctggagtgcagtggcacaatctcggctcactgcaacctctgcctcccaggttcaagcgattctcctgcctcagcctccctagtagctgggattataggtacctgccaccacaccggctaatttttgtttttttctgtatttttagtagagacagggtttcaccacgttggccaggctggtcactaactcctgacctcacgtaatccacccgccttggcctcccaaagtgctgggattacaggtgtgagccaacatccccagccttctttaatatatgttatttataatattggatgtgtgtgtgtgtgtgtgtgtgtgtgtgtgtgtgtgtgtgtgtttaaattaattttctagtagttgcctaatctgtagtgctgcttctaggatttctattaaaagaatatatattaaattcttattaaaggccagttatgatggctcataattaagatgccctaggagcaacaagagctgggtgggctactgatttccagatgggaatctggccatgtttataagacctggacttgaagatattgggcagccaacgaggcccatggaggagaattctggcgggctctccactgaagtacacctacctgctctcaccttcaatttgcctttaatgcctctccacttgatgtttacggctagccacttttaggatctgagccatcaagatgatggatgaaattgggtttggaacaagaaggcagggctattttgacccaggacacatttccaacatgctgtgaagaactctcagcatcaaataacatctgggtggaagaagttttgggaaagaagtctagctgtagatcacacaatgcttctaaatgggagaaaatgtccagctccatggcttagattctttgggaagtaggataactggctattccattttaggcaaggctgcctggccagaaacccatgtcttaccatttcgagtacattatggttggcttacaaatcgtagcctcatagagaactttttcttcttttagctactgtcttcctaaaataaaagtctctgtgcaaagcaatggaagaaacctcatattgttttttggggttgtcattttatgtaacttacaataatgactacggctcgtcttatacaagatgtaaaggatttgggagagggaatccagtgtgcatttaggggaagatggtgatgtagatagcatatttcaggaggctgggaagtgtcgagtgcttaaatatatgcttctcaaatttaatgggcatacaaattacctggtggtattattaaaatgtaacctctaattcagtagttttgggatgggtccatggacagcactttggttagttccccttgggactcccctttcccctcagagaagtgtagagggttggggtattgggcttaagaggagttccagactgtaaccatagctctaggtaactcccttctggaagtgatgtgttagcgactggaggagaaagggatccctgggatccttttcagctttactattctgatttggggttctgagattccaacaaagtggacttttgggagtcacagacctccatgggaatgatgaaagctgcgtaccttctttccgcacaaatgcaggcccacctttaattctgcaaaccactttaggccccgcgggcccgcagccctggtccaagacagctgtctgcttcacaggtcgcgcacccagagccgggcggttctgcagctcagcatctggcccgggctgcgcgtcgggctctggcgggggcgtgtcaggaggcgtgtccggggcgtgtcggaggcggggccaaggcgggggtaagcctcgcccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaggaacgcggccgcgccgagatcccagccccctagcgcggcaacccgcgtcgtcgcggcctgccccagcggacgcccccggacccggctgaggaagccacggcagccgccggcttctccctctctccctccccggcttcccgccccgctcccggccgcctccggcccggcttggatccgggctccggcccgcataggccccggccgcggcctctgcctgcgcttggcccctgggccctaccgggctctcagcaggcccgcagggcccacctggtccgggaccgcccccgcggccgtccccatcgcccccgccgcttacctggcgcccgcccggcccccgtttccgggaacgcgccggctcggggctgcggcggagcgggaggggcgtcgggcctgccccctggtccctgacgccgctcaggtaggcggcgaagacagcggccccggccggcgcccctcggccccgccgccgcagtgggccccgctcagggccatcttggctgtcgccgggcacagctggagccggaccaccgagctgacctcgggctacgggggcctcttggaacctgcgttttcaaacttttgcagggtttctgtgcgctggaagggatgggggtggggggcgggttgcccaggcctgtgccacctgtaaggtaggtaggctgcattggcctgggagaggcattttgttccaggccagggatttctgtgttagcattgcgtgcaggaagaaaaaaaaaaaaaaaaaaaaagaagacttaatttggtttaaatggagagatacaggaaatagacaggggtcaaagtgatactgtagtgtctggacatttgaggcagctctgctaattaatgactttccccactgggaatgcttattagctgtgtatggcttttgacagggggtgttgtgaaaataccaggccaggcccgagcctgttagggaccatttccttaaatttactggggaattttgagtagtaatgctatttttaaaacagggaatctcagaactctcttgacaactttagcaaactgcttgtgttgaattattaacagaataagggttggggtacccttggtagtcagtgtgaccatggttactttttgattccattcctcttaaagggcttctagcatttagttaggttcaacagacatttattgaatagttcatgtttatagagcatgccataattcagaaagaagagacaggattttatttatctttacatccctgtcaccctccccatgaaataattttaatatacataaaaaccagtgatagatatatagacaggatgatgtcagagcttagaggacactttctgtgcaggccctcagataattcattcaaattgaattagttattggatgcccactgtgttgcacagcacattatactgatgaagtataagattgacttcctgactgtacagctttacaatttaggtggtggtggttggggcgaaatgaaatggcaaaatgacaatttaggattgtatttcttgttccagatgggtgacttacaaagcttataaaaacaaggtgatttgtttgtttgttttattggtggggaggctgacagtttgaaatagctggatacagtgtgtttttttggttcaaaaaatatttattgagcatctgcataaaacgctcatgctgagtttatagagaattgaacatctctaactgtcctcatggaggttatccccctgtgaagatgggggagggaaggctatttagctaaacatgaaaaattactagttggaaaagtaataaaggtaacaagctgggttttgtgatagaagataatagagggcagtccgcttgataagatggtcagagaaggcttgtctggaaagctaaccctcttttacctgaagacggttctaggcagaggaactgtgtgtatgaaggttccaaagcagggaagagcttggagtgttctaggaactcctaaggcagtggttaggactttttctgatgctgtccgttctcctcagcccttgtatgttgatacccagttaactaaactttctaataagcagaacccattttagaaggaaaaaggacctaagacctctctatgaattattgccgaattttcttttttatcaatattgtgtctagtcttgattgattcaggaatgtgttatatcttgttcttgaaacttttttcattagtcagaatgaagtgcttgatattctcaggatgttgtctagaacagtctgttataaagcttgaacttaagcagcaatttaggatccttctttttggtttgttttgttctgtatcttaattgtgaggcccttgaagaggaaatcttataagaacccaaaaagaaagattcccatccaattgtatgggagtcacacctcccatactgtacttcatctgccaagggtcttcttttgctttagatcagacttcacagagtgggccttagaagatgtttgatgtacttccattccttctcccccaatctaattatacttgccactcaaaaaacttcctttctgggagttgttaatgaccatgctctctgaaacagcaggattcagttgtggaacataaggaatgtttcatgcagtagacattggacatcctcttatgtggtaagcactgtggtgggcactggataaccttgaatactttttcatggcttcatgtttatggcccaagagtggtccaggctggccaatattgctttcttaatatactgcttaagaaccagagctctggagttctgggtttgaatctcttggccaggattcagatatgcgttttgtgaccaggggcaatgaacttggcctttcgaagcctcagtttctcacttggaaagtgggaataacgcttacctccccggtggctttgagaatgcatgtaagcctgggacctgacatgtagtaaggatgcaatacacattagccatcattgttagtagcgacaatattgttatggtctcattaatggtcccttttactattggtaaatgagtccctaacctctcattatttaccacacaatttctttagttcatattactaggtcccactgttctctctaacctgttgatttccccacttttcattattgagcagtcctttcagagtatcctagatgagattttattctacttcaaactccggatctgtttttttctggatctgaggactctcaaatgaattacaatgtgaacgatatgaaacagaagtctagctatcaatttgctctactcatttttttcataggggatgggtagatggttggaatgggatttatagtgaatttgattataagagtaatcaacagacgtagctttggttgcatgtttatgctaacagttatggcttctaatctggccatttttgccactgtccctcagataatagggaatagctgctaattttgttattactcaaaagatttgagtgtcttcactcattctgactcatttttttttcatgttcattcacaaacacacccaacctttatacgttgagtagttcttaggctttggttctttgatgactaaagctaacaaaatgtagatctgtttgccaagttaggtaagtggttttatgaaagtatatttggcattaggatgagtttgcatttgagagaggaaacaatactcaaattaactactctgagaaatgtttttattcttaatgtttcatcaataatttgttaatgtagatagatttaataggaaaatttcttgcatattagggcctcattctgtggaaaagtattattctttagtccaagaaattttagccaacctaaagtacggaattgacttgtagcattcaagaaccttcctagccatggctagggctttcccttgtggcaaatctaaagcctcgtgactttagctgggttagtgtgaatcctgtaaagagaagatcccgttataccaggtaattaatcttagatatgtatagcaaatagtactagatagtatggttggcatgttagagaatagcatattctgattaatagagcttgccagttgagaattcaacagcttctataatgaaattgcataggcaggatgattccttttccagtagtagctgtagcagctagcgttcccatagcatgtagtaatgtttaagaaacaaaaggatgttgaagtgtaaagagcactggacttagactcagaaaaccatggttaaggtaactgctctgctgtttacaaacactgagattttagggaaattccctaacttttctcaactctctgttcagaaatttctcatctgttaaaatagggataatgcctaacctgtagggccattgtaagaatcacattcttaatgcatgtgaaagtgctttgaaaattatagaatatctataagtatatacagattgttattagacatgattatttgcctgctgtagctactaatcacttaaaatgtaatagatttcaaagatcgcttagctgagaaatgtcagttttcaatagatgttttcttaaaatggttagaatagaatctataattgattcagaaaaacattgagccatttgtaaaatacttgttacaagaaatagttagaaagtatatgttgtaggtgcctctgattctcttaaagttctgatttacagaaaactttgtgaccagtcgagtccttagctatttacccttagctgagcatttttatgtatcagtttaagtagaaagatgatagcttgattctgctttagaaaacacgcccagtactttaaaatgtaatgaagtatatctgttaagaaaaagtcaagagatttaaaatcaatgtagttatttctcccaaaaatatttgaatataaaatgtatatgaaatgtcctgcttttgattttgtttatctgtttttactaattagtctggttttcgagaaccatgggagacctttatcttaattttaaagaactgatttgtgcagacagtgaagagtttcaaaccccagaactgcttgcccttcccagtgtgttgcataacatttcttttactgtttaacataacctcatacaagttcacctcagcaaattagtcccccctcaaagctcagactgcatttcttcttatgttcccttaaaaattagagcaaccctagtattaaagtaaaaaagtggaaaaacatctcacctcacttttagaatacatattttctcacattttcctttaaaataccttactagcctgaatgtgtgctgaaacttgtttaagatgggatattagttaaccctgtattttgagtcgttttcttttttcgtaaatttttcttctttcactaatttgagaagctggattgatgtgagcccatagagtttccttatttttaggggtctggatatcataatcctaactccattctacataatcgaggtcagtctcctttgtagtctctaggaagtgcagatggctccaatgatacaacctgagaaactttaattgaggcttaaaaaagaaagggaaagtaacagttaacaacttttttcactgttcctacctaatttgatgctcacaaccaccctttaaaggtaagtggacatagtccccttcatagatgagggggtagacgtttatttgttccggaagaggtaggttttaaccacctgggtgactggtagcctttgctcctcttactactctactgcatggttctctgagcctctttaagtcatttcggccattcaggtctgaaggaagcatctttgccagaagtgatgcagattcaggaatggaggagagagattattttaggtttcagtcagggggcggaagctccaagcaaccagccaccttttgagatgattttggagccttggtgctccaagaatggtgcacttcatgttacaatgttctaaacttgctggagggtttacagtggcattttgaatctggagacatttcgattgggaatctccaagtaagtagaagactttaattagaggaaaccattgcagatttgaaaggtaatagaatccttttaacactatatataaaaggaactcatttgtcataaaatttaacaaatgttgtcgttctggctaaatttgtaatctgggcaaattactatttttgctagtggatgtgggttagcttctagctgtttcctcccaactctagaaaatcttcaggtgtctcttcatgctcggtaaggttgggagtttaatgtgtacttaaattaatagaaagtattcaagtcgtaagactggccttgcttgtagctacacagtgaaagggagatgattagccagtagtttacacaactcaaggtgggccttttgaatgaagaaaacaattacattgtatgcagcttggttctttaagaacaacacattattctccaccacggagaaagaggattaaaatggacatcacagcagctttttcgagctatattgtatttcattttacccaaaattgctcaaacattgaaaaacgaggaatcaagaaaagtgttgccagacatatatatctgaacatacacacacacacacagacaccaaattgttcaaacatttaaaaaaagaggaatcaagcaaagtgttaccagacatatatatctgagatatatatatgtcagatgtatatatatctgacatgcctatgtctatttattgcctggctttgctgaagaaatcagtgacattaaggagctcccctgatgattttggcagtttccctgggatctggttatgtgcctgtcatggggaagcatccatctttttggggttgttagagtcctcaggataccaggctgtgcctaggaagggttgtggcagaggtgtagagggtggggtgtggatctccagggctgtttggagtccttcccttttaattctctcaaggtgactgtgaatgaaaggagaaagactggttttgtgtaggttaagctggtctggtgagcaccagaaagatagggaaggtgccataatcgttgctcccatgagggagagaacaggaataatagtgcctgtgataataataacctgctttagtccaggcttttggttggacattttagatatattttcccatttaatcatcacaaagctcttttgggtattattttatttttcacaaatgaggaaattgaggctcatagaagttagatacttgcccgaaggaacataattgtaagttactgtctcagtgtactgtgcttcattaaacaggcttgagaaggtaatgtggcatttaattttgtggccaaagaataaataaggtggtcattgcccaaagagagaaaaagagctggcattatgaggacacttgaatttaaaaagtgtggaagggatttgatgagtattttatcaactcctgactggtggatgattctaacaacctggaattgctaacttagggtggctcccttttgatagtttcagaaagttgacataaggaaatctgaaagaaataaaccatcaggaaataaatcttggggaacttgctctgagtacaatgaaaatacaaatttagggtaggtttagataacgccttacatgttagagccataatgatatactatgggtagctgtggtttaaggcacatgccagaattttgaagttggaagtttgaaggtgtcagacaaatagacccttcatgcttgtgacagaggaaagactttgtagcacggtcttatgggcatgacccagtaaggcagctctgattttctttacattagtgtgggttcatattgtagttcataatgcactttcagcagtgcaaaaatccagaatgtccagggaatcagaagcaactactgaggagataggaaaccacttatgtccggccccacaccctctctgatttatattatcaacctagaggaatgggaatggagataactacaaaacctcataatggccattacacaagcaaaattagatttaggcacactgttttcaaacccttaagataatattctttatttaaaaatgacaaaactaggactcaagtgaaatgacttcagtttcacagttggaactagaactctggtctcctaacacacttcattttgttttttactttatcgaacaccatttgctttttgtttttataaacacttacacatcctaaacagccgcttacctcactgtatttggtaagaacagtaaattgtaggtttcaagttatggccacataaaagatcttaaaattgaggtaagagggtgagaatgaggggcaaatgtgggaacgagggtaggagatacgtagagagaaaaaggaggaggaaaaaccctcatgtagctttatttcttttataggcttactagcattctgtcctatgcattttgatattgattcatcagtgtcaagaattaagaatttaaattcttaaataaatattattcttgatatttattctaagatttaattaaacttgcctggggccaggaaaaatgaaaaagactcaaatttacccctacttgtaatggggaaaatataaatggaggatcatgtcaaattaagccccagggtacagatagttcacccagatataaaaaagtgaggcacacacgacttaaaatgtaaccagttaactatcaacaggttcaacggattatctagtacctccagagataggacttaaagtaagtgaataggaagtcagaatttcggagacaagggagacttcaaaaattgaacatattggccaggtgagatggctcatgcctataatcccataactttgggaggctgaggcaggaggattgtttgagactagcctgggcaacatgttgggactccatctctacaaaaacaaaaaacaaaaaactccaaaagttagccagacatagtggcttgcacctgctgagatgagaggattgcttgagcccaggagtttgaggctgcagtgagctatgatcatgccactgcactccagcatgagcgacagcaagaccctgtctctaaaaaaaaaaaagaaaaaaagaaaaattgaacatatgtgagtgaatactagtgaatattatatcataactaagaacttgcattttgtaaagttgaggatattggaagttttcctcatttttccttcccaccatctttctcttgtgcaagactgttgcttgtcccctttgcccatccttaccctttgagtatgagctagtggagctatttggtactttcccaaatctgcactataagcactaactttctgacttttgcaggtcttaaagatttagacagactaactaaaaacgcttcttccctaatttaataatgttaagaaagttacagaattgctaaagaaaaggtgagccagtgtgttccagttaatttagaccttgcttgtcagtggactctgggcgagttaccaagtattttcttagtgagaaataatgtggagagatggatgtttggatgagaccccagaattcgttcacctggtcacttcataattagatacaaagaacaagtctatacttatgctttgaacattttaatccccttcccacctcctttgtagctacttatatagattctgtactggtgacagaatttcaggttttgagaattttttaacacttaaactggcgcttagcttttaatgtgttagagcaatcattggcgacattctgtcattctcagtcacatataccttaaaatttttaatatattatacacttattaagcaatgtaactttttttaacacaaccttacatatagatccaactgatttctttttcatataccttacaaatttgttttcttgctcctttcgccatccatattactattttgttcacctcttctctctccttttcacctctttctttttgctacctagtaacagtcaatcagggtattttgctttaaagttgtttgtttcccagcctcctctccagttgtagtagaaggtgagttttaccttcccttttccagtgggatgcggggaagacttgcctgctacttccagagaacccttttcttcctgaatgtagtcagctcattttgcgtggtaggaggccagtggcttttagttgcttaggcttgtaagacccatacatctctgtttttctttctgaattctgttcccactgcacatttggtggggtagcatattgaccttcagtggtagagagaccagggtcagaccttctaggtttgccctagtacttctttcccatgaagtctccattctcacttcttcctgcattgtcatttctatgataaggtagtcagcagtggattacttcggtggtgcaccaaagacacttttcatgtcaaagtagctacattagcatttttcagtttttgtactttatagatggcatcttcttagaatcctaagaattttgataactggataggaaagactacttaactatcctttcttcagtcctggctcttttttctgcgtgttttgattgaatttgtttaaacacaaagttattgtaagcttacttccttcattttgttccccaaaacacaagcgtagatagaccactaacaaaaccagatatccatccactcactaaactaggggtgaaagaatattttgtgaaggcttttgttttaattggcttactttactggatgcatcttatcaaaaattatatctgtatacagtgtatacataaggtgtaaccagatccaactggatttgaaaatgtgtttaggtttctaaggggaattcacaggttttcttcttgtaacttctaaagtactcagctttctcattcctagggacactatcttattttttcaggcctattttagaagaatttcagcccctcttcagcagttcattgtcttattgtttgaagttagctaatttactaggaaatgttttatgtgtgtgtaagtttcacaatttatgaactgctaaaacttttgcatcatagatggtaattaatcatgggtaactctaaatcagtaatttaagttagttaagtaactcattctgtatttgtaggttgaaaacattgaaaaaatggacagaactatcttaaaggttactgttaacttctaagggcttgtagttctttttattaaatatatatgaaaaataaagattaagactgcaacacaatttaaacttgatttcagtttcatgtaatgtattacatctacatctgacagagctaagttttttaagaaagctcatgtgttattgtctctggtgggggtaatgtgatttgacctgttcttgaattagttttattcaaaatttaatataaaaatgcaatgtcatgttccaattttggtttgtttgatttacagtaaatgaactggaacttatcttttttactttaggctttcagataaacttctgtgaaaaggcacaaagtaagctacaaattttatgatattatgctatttatttttttcatatccatcttggtattgggaatgtgtccactattgtttcagctaaccagccatggcaattttacattcaaagagctaccatttttcattcttcttccaaatattaaaaaaattatattcttgattgtaaattgtacttttttcacttgaaattgaaatagcaaaatatgtataggtatttagatgtatataatatggaaatacgtatttaggtatagaaaagtatatataggtattcagacttaaccctaatttaaattacaagtagaagagaattcacttttaagatcgtggtgcagaaagtatagagttatattcagacatcttatgctttaagattgaattattataaaccatacattgaatatatttttaatttttttctttaaaacaaaacagtgtttttcttctgcctccctcaccatccttattctgtattaggacactagtcttcatataatacaaaacagactttctatatcaaaaaaaaagttataaaccttgtattttatttattgagacagggtcccactctgttgtccaggctggagtgcagtggtgcaatcatagttcactgcagccttgacctccctcaagcgatcctcctgtctcagcctcctgagtaactgggactgcaggtgcatgccaccatgcctgactgactttaaacttttttgtagagacagggtctcactttgttgcctaggctagtctcaaactcctgggctcaagagatcctcctttcttggcctcccaaaatgccaagattacaggtgtgagcgactgtacccggccaaaaaaaaaatgcatttaagcttaaatgtcatctgtatcaagtacagttaaaaaaatctcatctcaaggagactactctccagttaacataaaaatataccaaaatatgatataagtcgttttgtcttctgctttttattcatgaactggagaagaatgatgctttgatatgtgtcattcttaagtacattgattcaaaggcaaaaaaaattaacctggaaaaaacatttctgctatgtttaaatttttttttggaatgagaatgcatagtttccactgattgattgttatgactactttgaaatgtagttagcaaaaatttatttcttgaatggttcacccacaatgtaactgtatataaataatagagatcaagcagttagaccctaggataaaagtttttttaattggttcattactgttatgtctcccttgccttaaataactgactaaaagtaatatatgatttcctgctcatagtgaacctttatatatgatatatatctatatgaaatgaagttacaacttctgttttatgcttttaattttgacacattcactgtgataatttttagctttgacttttcaaaatgtctgcttaatatttagcatgacaacgtttagcttttatttgtattttgacctaaaatctaattaatgaaaaaaaaaggctgtcttctatttttgttcatttcggagacagagtctcactgtgtttcccaagttggagcccagcctccaattcctgggttcaagtgatcttcccacctcagcctcccaagcagctgggactacaggtatatgccaccacacccagctcattttaaaatttttttgtagaaatggaatcttgctatgttgcccaggctggtctcgaactcctggctttaagcagtcccacttcagcctcccagagtgctgagattacaggcatgagctaccacacctggcctgactttttaaaaattttaagttgtactcacattattgttcttttatttaacctagttctattgtagatataaaacaagagaaacattgattatagtaaaattgtatatacagtgtctataagtagctttgtatgtggattaaaaatgcttttgaatcttctaaatggctctgtttttgtcattatagaaatgataggtttgcagtgcggcctgctttgatacatatggaagaatttaacaatggaggctgggacagcggaacctgttagaacttaattatgtggtggaggggcatatgtattcccactttgattattcaccttgattgccctcactgtctctttacactgtggctactttctgctggcttttcacatctctctttttatttctgcctcttcccattggaaggctcctctttattttccagttttgggattcaacacagttatttatatacattcacgaaatcacatattggacacctagaaaccatacagtaagcgagattcttggtacagaaatgaatggaataggcccctgccgttagcaagctcatagtttagtggactagagttgatcctacattgattacataagtgttcaaccaccgatgttacatactaattgatttttaactggaaccagggtgaggatggtgcaggagtggatctgtcctggtcacctttgctcctgctgttctctcatgagagagaatgagcataaagggtgctgagagtctcatgataactgctttcttgattggacactgtgtcttagggatccaacaatgggcctaccctgctttggagttaagcagatgtgtctgtgctggctcagacctcagtgaaagactcagggaatgggagtgcacacatcagggaggggagctggagacttggtagagatggctagccctaaattgacagtatttatttttgtactatcagtacctatattttagtataagttctcagttgcttacatatattagcacttcttctaaatctggtcctgtgatttgcatgacttaaaaaattagaagtgcaaatctgtaatgtttgcagacaatctgctggtttgctctggaatatagacattaactttatggtaaaagtggtcacacttttctttaaaattgggcttgggctgggcacggtggctcatgcctgtaatcccagcacttcgggaggccacggcgggcagatcacctgaggttgggagttcaagaccagccagaccaacatggagaaaccccgcctctactaaaaatacaaaattagctgggcgtggtggcacacgcctgtaatcctagctatttgggaggctgaggcaggagaatcgctgaacctgggaggcagaggttgcagtgagccgagattgtgccatggcactccagcctggtcaacaagaacaaaactccgtctcaaaataaataaataaataactccatatcaaaataaataaaataaaaataaaggcttgaaatcatcaaaggactgatttctccactgttggggcacacttatttctagaatctccacttttattctaaggatatttcagaattatcagataaacttatgtttaatttattaaaaagaattatgtatcatacagtagttgtaggagggtatggggcaaagagcatgaaattagatatcattcaagtctgataagtctgagtactggctgcttcaaatgctcaaatctatcacaaataaaaaagatttattgtaagatgattctgatgactaatggaagctctgaaggattaatttttttcattgactttcacatagtttttgctctttatattgctatgtcactctcttttaatcactttattacagttgcctgttacaagtcagtggagttttattggagatgtgtgtgtgtgtgtttacatgcacaaatagcgattacatatttaatttgggaaacatctctgtagaaattcaataaaaattcactctgctcctcacagtcttccttttatagattatagttcatgcatttatctattcttcagtttattttctaaatataagtttattttagataaaataaacttcaagttacatttatttaagaccatagtgtcatgtttcctttaatactgttggatcattgaatttttctgaagtctgaatgtaagaacactttagggaaaaaatatttttccatttgtaaatgtagagttataagtgtagaggtcctgccttagaaggttgattaatttatctgttatttgaagataatgtttttgtacatgtaaaggtatttatataatttatgaccgtatctcactgactttaatgagctaacctgtgaacatagttgtttagaatatgacttacttgctttataaaaccattttttcattttttatttttcgaggagggatgaggatttgcctgaaaacatttttttctcacaagctgcccaactaccaaaaaaatcattcttccaaaacctcctgatgttgattcctcatgaagagcagttgagttgcccaatgtgtgccactcatgacagaagcccccttttttagaaacacagtttttaagaaatgcttttatgaagttgaatttaccttagtgttgtcagcattctaatttttttttttttcagatgagaatcgtgactcatttaaagatctttgggcataggaattttcctcagaaaatgcctaaccgaattgtgtgctaatcagagtgatagtagctaggcgtttggcaaatactcttctgataatttatttttcacacaaaggtgcttttagctctttatcactatcctcccccccgccaccttttttttgtagctgtagtatattatcagttcatggccgaagagttctggagctctaaatattttgggtagtgttaagtttctgtagctttgtcttttacgtttttggtggcgttaaaaactttgtgcttttaaaaaatgatttaacttggaagtgtttacatagcaacaggatatttatttagaagattagatgctccagagctattattctggatgctacgaattgaaattagagtacaggtggcggtggtttttggtggcactgcacatcagtatatttggaggaaaaaaaggaggcatcctggagactgattttataagtatccctaattgttttttaaattggtaataataaaaaggaaaccataaagaggaagaaggatgttttgtgaatcttccaagaaatttgggaaagatactaagtttactgacctgctaagaagtgtctgtaaatgatgatgttttgactttattggagtggactataggaaaacaggaaaagcaaggagcaaagggaaggttaagttgttctgcatttaaaactaagaacttagaaaattcagctggttaaatttctgattcctcgttttatgtagcaaaagtctgcagccagtgacaaaaattatataatttggaaattattaaattcaactgagtttgtcagcaatcctaagaaacaaaatgtcatttactgctcttggaggtttatacagtttatataagtttatatatatagttaatgaagttagttgaaaaatgagacttgtaggattagccgtaagccagactaacatctaatatttattaccatttgtggggaccatgataaattgtcaatgggaagtccatctgcttggaaaaaagtttttatattagttaaagcccaggaattgtagaagtagaagtggtatattccagagtcaggattcacctattcctctcatactttatgcttataccttataccattacaaagggaatgttgcttagttgtctttgaccttggaaatggtgggaacatgaatttgtcctgaaaatgctttttgttgctaggagaaggaaggtttctaacagctattgcaccttaaaataatttggggatgcttaatgtgtgacatttttgataagaaaataattagtgactttcccacattgcagaaagttttcatttatatgccacttgaactttactactagcaacaaagggatgttgacagaactttcagagttgaacagatacagagtagaaatgatatggaacgtttccagagagtattcccaactgaatccagttaaagtggttttcaatttagctcatacatttagggtgatggttttcagataaggtgtagtaaatatttggattgtcactacatggttttatgagatccgaatctaggcaaaaatgtacagttaataagatgcactaagaaaaagttgtgacttccatcttggtgttcattttccctgggtagaaatgccaaatgaacgttaatcagaaaggaaaatcaagtgcgtacgaacatattcactcccctttagagaagctcttacaaggataaggaaagagaggtacaaatgttaacagttaacaaatgtgtatctatatataccttcgacagataaagatattaccaatgataagaagcactgggatccttaaagatgaattaaatctagagcctactctgaagaagtgtatgttctttgagagattgagcatatataggagctatgtggtagaaataataactcttaatgtgtgtcaaatcctgctctaagcactttatattaactcctttaattctcacagcagccttatgaagtaggtataatagttaatatagatgaggaaactgaagcacagagaggttaaataaaatttccaaagtcatatagctaataaggggcagaactgtgtgaccttggtctggtcacagtttacacgttgtaaaccttagtgttttactaattcttgaaagcagttggcgcttataggaatgattttctaaatcaaatggcttttgaggagtcctcatttgcactaggttatgagatctggacctaccatttgtatcttggtaagccatttgtaaggcttatcaaggttatccagtaagccttactgaacattaaagtagaaagattcgtgttgctatgaagttaggaacacaggggatctaccactagggaaaacgatgtttagtgaaaacctaaaactctcctggcctagacagatacaaggaataaattgctccaggattctgaaatgacttatatgcctgggtacagctggagaagattagtaggtcaggagacctgtgaagtcagtggacaaggtggcacagccatgaactttgtgaggacagactgtgtacagactgtcataagaacaaactgatgcttttagcaaaatttttatgcatccccaccccactttctttttggcagggttagaagaaagatttaatttttgaaaacttttaatagtagaaaatttcaaacatacacaaaaatagagtagtgtaatgaacccccatgtacccattatatagcatcagcaattaccaacatatagccaatcttattcttcttccctccagctatctctgctgaaatactttaaagcaaattctgatgatcattattttatccacataaatgtgttacatgtcttctaagtgataaggactcttaagtacataaccttgatacaattatcttaccattaaatgaacaaaacaatattactagatagctactcaatgttcacatttccccaaaagccttgtaaatgctttatttacagttaatttgttcaagttgagacctcagcaaggtatgtgcacacattgtgtttggttgatatgtctcttaagtttctttaagtctgtggtaattccctcttctctcttttccttaccattttttttgtttaaaaaattggttaatttattttgtagcattttgtatattttgaatttagctgattgcatccttttagtgtttaacatgttccttcatgccctgttatttacctttaactggtagttacagaaacttgatcagacttttggcaagaacacttacttcatagacggtgttgtgtgcttcacatcacatccaggtgtgttgttgtatcacatcaggaggcatatgatttcttgctggagctcttgttaagataaaccaatgggcttaggtgctgccagtgtgatccatatagtgtaaagttctccgtcagcctttcatctggtagttctggcccattaactttgcctacattaattattttcttaggaagaggttgactctcattttcagacatatgtgggctttgcagatagtagttgtatccagccaaaaaaagacaaaatttgtgtttggggcatacgactgaaagcaaattatagttaagccttggtcatctctgacttaactatgccagtactgaaggatatgaaagtgtatttatatgcacacatatgatatacaaacatttattgggatgctctgtattttgatagaataaaaactggatacttgtcctttctaccctggaacatgagttgacccgttcattagggctcattaatctttgcagataatcaaaagccacgtcaagtaataagacgttctctggtgaagttgaggagccaatggttagacaagactagtcctgccaaattaagatcaatcccacatcagagcccagcttttaaaatttgtgttcagtgcttagaatgctcagatccttcagggcattgccttcccaatacttgggaatcagattgagtcatcaaaagtcagtttggtgaggattagaagtgagtaagagttctcatccaagatttaataataaaaatctgatgacctacttgtgttttaattagtaatgaccttttaatgaccagtgtattgttgtccagttggtgtcatttaccctttagcagtaataatttcttaaccagctttccttttttcctattcctgttccatcatctaactttaactaaattattaaagtctctctctcataatgttctacaactaatttgctcttttgattttctttttgggtctttgtaagtaacaaattagaaacatttcagtcgagattctctcatgtactgtatacacatgaagtagatagaatgcagcatatcttctttgagtgccattcacgctcttgattattcttaatttagtccaaccttttaaaactttcaatttgtagaatacatttatgggcagcaaatagttttttattgtgtccactaggaaataaaagtgtcattcacgtgttaatatttttgaaattgggagttatttaatgagggtcaaaagaagccatttggatgggaagaggagtataatattgctaattattacagtattacctttgtgtggaagatgcctgctcattttctacctttgttatttgcttttgtagtgacatagttggattttaatttaaatttgactgtgaattgttacctaacatttcttaaaaatgattatatagtgaaatgcagtgctgaaatggaaagttggtggagtatacaaaagatcgccacgtcttatgactcatggcagttaaaaatgccacatatcgttttcaaagccagaagatgtctgactaatttttgtgtcatgaaattctattgttagcatttttctactaaaagcttctggtaactttttcagagaacctgcataacatccagttatacatattttgattaatgaggaaaaaaaagaaacaacaaattggacccatcaggaaatacagataaaacaccctattgtgtctcttagtgaaactgtttgtcctaaagatgttaaatcaaacatttgagcttcgattccttatttattgaagaaatatttgagttcctattaaatgacaggtgctgttacgaaaagaactgagttgtcggactcattagaatgttctgtctgatttccaatggtcagaagtcatgccgatggaggctgggcgtggtggctcatgcctgtaatctcagcgctttgggaggctgaggcagatggctcacctgaggtcaggagtttgagaccagcctggccaacatggcgaaaccccgtctctattaaaaatacaaaaattagccgggtgtggtggcaagcacctataatcccagctacttgggaggctgaggcaggggaattgcttgaacccaggaggtggaggttgcagtgaaccgagatcgtgcctgggcaacaagaacgaaactttgtctcaaaaaaaaaaaaaaaaaaaaaaaggtaccatgtagtagtaacaggttatttgaaggctctctaaatggtcttaattaaaatataaacaaaattatgtatatgacttaattattcttttgcctttccggattcttaaggacagatcatggtgaaaaacagttattacaggtaaagtggtgtgaattgtttgctttgagggtaaagtaattggtcagttggacaaggtagtcaggtgtgccctggagggtggagagaagtcagcttggaataaaaaattaactgaacctgggcaacatggtgaaaccccttctctacaaaaaaatacaaaaattagctaggcgtggtggcctgtaatcccagctacccaggaggctgaggtgggagtatcgcctaagctcgggaggtgaaagccgcagtgagatgtgatcatgccactgcactccagcctgggcagcagagtgagaccttctgtcagaaaacaaacaaacaaaaaactgtgattcactatggagtcgaaaagaaggaaggtagactctctgactttcctgagttaggatgatgtggacgtacacactctttgctttaagaagatgttcttggccaggcgcagtggctcacgcctgtaatcccagcactttgggaggccgaggtgggcggatcatgaggtcaggagatcgagaccatcctggctaacacagtgaaaccccgcctctactaaaaatacaaaaaattagccgggcgtagtggcgggggcctgtagtcccagctactcgggaggctgaggcaggagaatggcgtgaacccaggaagtggagcttgcagtgagccgagattgtgccactgcaccccagcctgggcgacagagtgagactccgtctcaaaaaaaaaaaaagatgttcttgaagtcaggagtctgctaggtatttgaaggacatctggcttgataatccttgataatattttcatacctgtttgtaaatcaactattgatatatgatggagaaaaatatattcataaaccatatcttcctactttatctctaattcacttggaatttgttttacttgtttttaggcttgtttatgtatttggatagttataaaaaccaattacaaatattaatggaaataaggaaatttttatttcatatttccaatattgacaccttgaggtgttttctgacaccaagcaattctctgacagcaaccgtgtatccaacaattgaattcatttctgacactatttacctggagttagcatcagatctcacaagttgaagggctcagtgcttcaagattctcctcacttaggatgctagtcacaaatggggtgtttaggatactcatactcctgcttggatgacttcaaatttgggggttcccattatcaaacttgaccacaacccccatcaagtttgataatttgctagcatgtcttatggaactcaggaaataactttatttactgttattggctttattataaaggttacagctcatgaacagccaaatggaagagataggaccctgtatagggcaaggtattgggagtaaggggacaggggaatagcgcagaggttctgtgacctttccgtgcacactatccttgattcatttaccaatctggaagctccccgaaccctattgttaggggtttttatggaggttttattaggtaggcatgattgattgtatcattggccattggactccgtctctagtccttttcaccttcctggaggtgtgtgtatgggggcgtggcagctgaaagttttaacagtctactcacttggttgtttttttctggtggccagcccctatcctgaagttatataggggccctctgagagttaccagactcttgcacaaagtcaggtatggttgaaagggccacattatcggtaacaaaagacactcctgtcactcaggagattctaagggttttcagagctctgtgccccaaacctgggacaaaggcaaaatacagttatatttttcattgtactacaggtacttctgtagcaaaattaccttgcacacaattggcccacagctttgaatctatctgggaaaaagagtggtaatcccataatgggttgtctactggattggtgatttttctgtcgtgaaaaggatgaacatggtttgtttccttggagcaaatgggtacttaggctaggaagttctctgcatcttatagctttctttattctaatctacttgctaatgaagttcatatagaattgaagtgcagaagagttaattacttatgacttatgaccagtctggctttcttgtatagttaataacattattacttataacattataaacttgccaagaaggagaagtcagatctgattgttttgatgtaaggaaaaactcaaacttttttcctctgctttcacaccatacaacaatcaacatagaagactttgtgaccaaatatgggggatttctccccactagcaaacaaataatcacttctgcagcacataccagctgggtgtcctccagttcaattatcacacagcttacctggagatagtgtcagatcccaccggttgagggctcagtcccacaaggctgcccctgcttcagataccagttgttaagtctgggccttcagaacttctgactgtccggctcccagttgggtttcccacaaccctcctttggggttaattaatttgctggtctttctggtcaccagccctcatcctgaagctaggtgctgccagtcatcagtcaactcattagcatccaaaaaatacatcaccttggaaattccaagaatttaaggagttgtgtgccaggaaatggggacaaaaccaaaaatatatatttctcaataccatatttggtagctcctcaatttgtgtgctgttgtgagtacttacgtgtcagctgaaatatggatccccttagccctgtggcctggggccactcactagagctctgtgtcattgtccttgagtcaagaacagacttatatttctttcattgtgttgtacacattttttttttcatatgcacatataaaaaaggtttggaagcactgattgaaaaaatattgatgttatagttataaaatatggttaatgtttttatttcacttataggtggtgaacagttgttaaaatagggtggtgataggatgtcatggcatttaccaagcaggaaaaataaatgtgatgtaagacctgtgtgcacgtggttccttgctagggttcaagcaagctgttcttcagagagtatctgatatgtgcttctgtctgtacagtgaggtcagactagaagccactccgtgggctctgggatatagatggaaatcagaacaagccttatgacttttcttgacatagctttcataagtttgcatattctattccttattccattagtaagattgctactaaaaaaataagcatcagttatgtggatggttttccagaaatctgagtatcttgttcttgttacattgtgagacagtaacttaaaactttggggtgctcatgaggagcttaattagaatattgagttggattaggaggcagaggttatcaaagtggcctgtgtattgcaaagtaagagaccactgttgactgttgtacatagaaaattttgttggggttgatcaatttgggtttgtgtctcacttgtcttcatgggatttctgttgatatactcacaagttcgaggcttaaaaacacaaatgccctttggatttgccagagatttaggcatcacatggatttaaaaatggtctgagcacctggataaaatgctgagtacctttactgactcttgctatgctgcaaatgtttcctcttcctggctagaactctcagcacatgtatagcaatagtgtttctgtgtgaatggaatcagtgcaggtatgtagcagattaggccgttcttattaaggactgtgaaagatgatggtatgagtgaactctttaaatgagctagggacaaattaaggattcagagaactattaacacattctcttctcccctgaaccaaaggtggagataactggctgcctccttttgggtatccatttggaaccttctcagagtggttgtgtaattgtgaaattccaactcttaggttcccatgaagtctacttgcaaaatcattggaacatggaattggggttcggggggttatttcggataagctttttatattttgttggtgattaaaatgttgttaaatttagcaacattttaaactacagtagggccttctttgattagctggctccctgggtaatttttatggggttggactaatcatgacttggccagagagattttcaatttagcctgtggaattatatatttgcttgttggtagtagacatctggctcagagtctgatagaaagtgttgctgttattggctttaagtgatagctcaaaggtgtggctggctgtggaatcccataatgatggcactgtgcttaattgatgtgaaataactggagatcagagaggggctattataatcaatggcattggtggttagctgaatcagagaatggatgaatcagttatgagtttctgttaataggtttaaaaggaatttagggtgttttgggagctgcattccatgaagcttcataaaccccttattttattataactgaaatgagttaaattttttttttccttgttagatgagcagcttggaagcgagttttgggcttttaagccttccaactctccctgaaggcttttgttaaccaaagaaggactccatacatagtaagaggtagtctacaagtagaatgctgcttttgcctttgtctggtgttctaagaatctgataggagctgttaagccttttgttgtcaaagcagtaccctttcaggaactgatagaggagtgacacaatccttggtattctgggttaaattttttttttctacccaagaaaaggactatgaatcttttgccagaggtcggaaatgctgagggtgaattattttgttttttttttccttgacagtagagcctctgaggcccgatcctgtcagatgaggaaaatgtttaatatttaggaatcatggctgttagtaatctacttttaccctggtttaggacttggccatcataaatgtagacagttatcataattgataataaagctggaatgagtgactatctagctgactctgttatgcatagtaatgcctttactcctcacagtgcccctatggggaaggtaatattaatcccatttggcaggtatggcgctaaggcagagaggtgaagtcatttacccaagagatattatatagctagtaagtagcagagttgagcttcaaaactaggccgattggcactgctagtctatattgatttccctggtttctagtttaatagaattaggaaggatcctggattaggataggaataagatttttatgggaaagtggttttaaacacatttacaaagcaagctgaattctttgttgctaatatattttgttggtttaaacgctatcaaacaaacattttccagttttcttctctagagaatttaatactttctcaattaggttttaatatgtacttataactaatatcatagtagttaccacttttcatgtctactgtttgccactattatagcatatttaagatatattaatccttatcacaacagtactgccaagtagcagactgtttttatcctggtttcacagatgtgtagtgtactagaccacagaaatattcttgtttgtatcttgattagtgttccagtggtatttattagtattttcagtggtgatcatttgacatcttggaaaagaattttctttcctattcctaccctttaacctccttgtactacatttctttttctttttttttgagacaggatctcactatgttgcccaggctgcttttgaactcatgggcgcaaacgatccttttgctttggcctcccaaagtgctgggattacaggcatgagtcaccatgtctggcctcacatttctttttaattttttggcagaatgcccaacgaaacagtctttgtggaggggtcagctaccttatctattgttcatctccactgcctggcatataacttgtttgtaattgtggtatttctgcacttgttgttgtgtaaattattatattgggctttctaaaaatccattttacacacaaaagtgtaaaatgtgctaaaagttgctgttgggatatttacttgatttcttaaactcagaaccatctagtttccaaaatgcttagctgtgtggatgaacaacagtgctttattgatgagagttcaaagttctgagtgagattttatgaactttttagtaattgctcactcttatgtatcaaagattgccagtggggggagataggggcaatataatattagctgatagcagctcacttaatacatggatatatggaatacctgatattgcgagtctaacatctctttttctttatttatttttatttatttatttattttttgagacgcagtttcactcttgtcacccaggctggagtgcaatggcgcgatctctgctcactgaaacctatacctcctgggttcaagcgattccattgcctcagcctcccgagtagctgggattacaggtgtctgccaccacgcccggctaatttttgtatttttagtagagacggggttttaccatgttggcctggctggtcttgaactcctgacctcaggtggtccgtccgcctcagcctcccaaagtgctaggattacaggcatgagccaccgtgcctgacctaacatctctttttcttttgagcttatgaaatattaggtctctcattaccgtagtaatttagggagaaaagagaatgaaagtaagttctttactaccactttatttcctcatttctgaaattgtttgactgtaaagttgcatagttggaattgtgggttactcatttcataaccagtgattgcagataattaaaaaattattccaggtaatctttctgttttgaaaatgaggtagtaacaatgagagccaaggaagaaatgagaatttaaatgacagctcccctctctgcgatgtgatgttctgaatacttgtaagtcaaataccaatattcttgaaggtattctatgaatgacttgtacactgcagttccaggtttctctttattgtgtggtggttctagggaataccctgtggtgtcaatgggtgttccctaaaagggattgattcagattgctttttgattattccttcctggctcctttcgcatgtgagtagttgacttgaaagagcaactgtttaatttttatgattcttttcattagttgggtggtagttctgtctcacctgagcttgcttatatgtatttagtaggtctattaggaagactgggactgctgggccttttgttccatgtggtctttcatcaaggagaatagactgagctgcttcacattcaaactcagggtagctttccaggagggcaaaagtggaagctgcaaggcctcataaagggcttagatttggaagtcatacagtattccttctgctatagtattgtggttaaatcaagccccaaggccagcccagattcaaaaggtagggaaatagacctcacctatttatggaaggagcagcaaggtccctttgcagatgggtatggactcagggagctgtggttccttggtggttatttttgtgacaatctaccaaataacctacagtgaactcagcattatatcaaaaaggttatactctagaggcagctattgtagatccttcagtggtcttcattaccatgaacaatgaagtactttgctgttactacaacagatgttaaacaagggctatcaaatatggtgatatcagtggagttgaagatatgcagattggctaaaatgttgtagagacggtttccattcttacaggctgggtgggaggattctagtgattgtagttctctgattctgaccatacaggtaacagaatcttgctttcctgtgatataatgaaacgaaacaagcccattagatggcggcagggggcagggggcagtgaaatgttgataagaaaaacaatctactaataattctaatttaataaatatttgttgaactgctgttttgtctgaggtactgttataggtgatttgcagagttcaaagataaatcaagatagttaaaaatttaaagcagaaaattgtttacaattttttgatggaaacagacttgaggatgagaggatggtaaggtgagcccagtgtaaagtgtttcttcctgagggacatactgatgtttttggaaactaaataatgctggctcttaatagaggaactgacaccttttgctgttctataaaatgtgaaggagagatgcttttggtaacctagattgcagagattccatagattttgtattgagtagtggactctcaactgcccgtgttgaggtttttggccaagatcgaagcaaactatatgctcagcttagctggttgtggaaagcaatgttaaaaaggtttgtattgcttgagaagttagtggagggagaatattcagggctctttatcatcttgtttttaaagctaaataaacctggaaggtgtcttccctccaacttcaatattctgtgagtcagtgagttgctcacaactagacaaagggtattcctaggcctcagtgaatgtggatacacttgaccaatccctttcttcaggattacagttcttaatattcttgatgattccatgtttgggagtgcttttctcatgagaaatttgaggaagacactgtgtgccgatgctgtgaaaagcttgtttgaaaggtgctggctgttctcttaaggcagagttttgaaaccagaatttcaaggatgattctgacagattgttgccctcagccttggagtggctgagtggggacaggactgctcaatgcctaggccagcctctgggccagctgcaattctaattttcccagcatgttgaacaaatattctcatcttttaaacaagccattgcatgaaaaaagtaggcagtattgctttgaggggtggaacagtgctttggaagtgtgatgaggacaggtactgttcctaagtcagggttcttggttgcaaacaacaaagatttactccagccaataaccatataggcttaagttgtctgaggctgtccatgtcaactttattcccaaatcaataaacatttggaagtgttttctgtatcaggcacagagctaaggttttaggtatacagagaatctctcgcaggaaaccgcttctgtataaatattttaggatgtttgatgcctcgtttctctcctgctatagttaaagggacaatgtttatctgtgttgactggttagaaattgatgatatgacagtcccaccaaaggggttattataatcacaaattcataatgtttttgatcagttattttaaaccctgttgtacaaatatttcaatctttgttagcatctaaaaatcttcacaggtcatttatagtatcacgtccctcctttctccctgtgaaagttgtttcaagtttttgaaaaaaattcatattaatgtcctatttgcttgtaattttttgtcattaaaaatatctgaatacatggtgacagattgcctttcggttttgatttttttgagggacccttgaaaaagaagtaaaggagagaaggacccagccccagtagaggctctagtacttagagaaagtgaatgggagaggagaagatgcctttttttaaaaaaaaaaaagctcatgcctccaggtagccagaaacagcttctcctgagtattgtaaaagctatttttctacttttcttgaatctcaccttcggttgacattttggggccttccttttcctcctcaaaactgcctttcaagttcatcttaaactgatcagcatttgaagagttggggtacacagatgagacccagcaaggtaacttgatcatgtgctaagctcgttggcacttgttttaggctttgagtgatctttgcttggaaaggcttcgaaacctacagaattacttagtgtgttttgttagtaaatgatcagaatataaatttggactttttcaagataattgcagatgtctctgaagtgtagactgtgtttaaatctaatttatgtaacttaaatcacattctcttcatcatggtgtacgtttatgaagttaatggcctttaaagctttcaatttagtttttatttaaatgtgaatgcaatgctgaaaaaaatctctctgtgtattcagtataaatacttatattcaagaaaacagtttaagttttaactgttgtaatatattttattgtttatctggtaaggttagctactattccgtcaaattgggctttctaagaaaggaccaatttttgtttttctttggatagttttcacaatagttctttgttctgtccttgtcttgcattttatcttagtcttatattaatttttcttcacacggaggtaatggatgatgtgccagatggtttcaaacacagactacatgacatatgctcagtttttgatttgaggagtttgtaaagattttcttcaaattgtgatagcaaagttccttaacttaattttttctgtaaacgatttgccatattaaggtaattaataggttcaagttccagagattaggagcttagtatctttggggaccaccattcagcccattacagtctgttttctgggccccaaatattcatatccttcccatgtgcaaaatacatttaccctaccccagcgtctccaaaattttgactcattacagtattaactcaaatgtaaatctcacctaaatattaccagctcaaaaatcccaaatcccattatgaaaatcatttaaatcaggcatgggtaaaactctgagtattatccagggcaaattccatttggtttcaagacccgggagtaatcctctatctttaaatattttctaaagaaaaattctcaagaagtaaaagagcatatttactaaaaaaacctttttttttgtatattgctgaacctctcacagaaagtttttctaccagcaatatatcttattagtgattcttctacctagccattctgatcatcatgttatcattatgtatatataatataaaaccttcaaactttgccattttcatatgaacaaaagcttaaaatgtttttggtgttagtgtctttttatattttcccttgatttgtctttactgctcatattcttatcactttttttctatttttcttgatttctatgatgtctttatatatttagagctactgatttttgtattgcaagagttttcccaaggttcaatttttttttagttttgttttttggtaatatactgagggtttttgttttttttttaaatacagtcatatctgctatgtttcctagtgtaccctttgcacatgttgtttgaatgtccttcctctacattatgtggaaaagtcatactgtactaaccttatttctgaaaatggatgtgtttggtcttcgtgggaattcacatgatctggtagaaaggaggcttatctttgaaagcagatctaggggccgtggcaaggagctctgtgctcttgtctctttgccatcttctccatccagtgtggctccgtcagattttcagatctcacatttacagtttgaaccctctattaaatcctcatccactgaggtcagaaagtgtttggattgcagagatattttttgagtagttaattgtataataaactctagagagtgagttcaggaaaaagtgtctctaaggtgaatgtgaaaccaagatatgctgcaaatgcttaaaaaattcagttctgttacaaggtatccttttaagtcctaaagaaatgattctgtaagacttattgatatagaaagaaatgttagtgaataaagcattttacaaagcattttcatggtctgatttcaattgtagtgaaaaaatacatgtccctatctatgtatagaaaaaagtctgcagtagttagtaaactgattattttgagatacttggattgataagtttatgtaaaattttaaccctatgtattgtataggtgtatatgtaacatttttaatatatttgatctttttttgcattttctgcccttctaccatggtggttttacttgggtaataaaaaacattggtatctcttcccttcctaccctaaagaaacagcttcatggaaataattatttagaatacttgtattactaacttgaagtttactctaccgtaatgtttttagcaaatttttcagattcttcactctgttgtttatattcattaaaatgagggaaaacgatatttattaaactgagggcattaagtataacactgaacagatggtaatatttttagaatttttcagtatatctactgagataattgatttttataatagtattttcacttgcaaaagtattaacttccctgaataatggaaacttgaagtgatagcattctatctattgtatcatagcctagtgaatgatttgtagttagtaacaactttagattattttattttttcttagtttaagaaattcctcattgcctttcaaaatattgtcctatattaactgtttgttaaagcaagttctcttgccttttggtgtgactttcttatgccctcagaatagtacctgttttgtagtacttgaaacttttactttttatttgttatttctcaggtaaacgcaaagcactgaagttgaattttgcaaatccacctttcaaatctacagcaaggtttactctgaatcccaatcctacaggagttcaaaacccacacatgtgagtattcttggtaatcaaaggctcaactcaagcaaagattttaaagttactgtattttatgaatttttccaattatgagatgtcagtataatttctctgactaaactctctgggaatattgtttattcttttccttctggagttccagttaaattgcaagttgcatttaggaaatttgactgtcttctgtccaactgtacaaattttcaccacttagtgacaaaatagagtcccatcttaataagctagattcctgcaagatttctatgtcatagtaaattgaaagagttgtgtacatgtgagtgtacacatatcagtggttatttcatttactgaatttttaaacaatagaaatgatattgtagcatcttagtgaaaatattagagcatcttagttaacataaagcaataccttcagaacaatattttacattaaccttcaattgaatttaagtgatgtgaaatattaaaaaacctcttcttatttcccatcctaacctatcatgaaaatgaaggccagtggctgtacttttataaccatgtccataaaaataattttgagctagtttcgatgttgagaactataaagcaagtggtgtaaggtatgattaaaaagctggcagatacatttttttttaagtaatttctcaacaatttgcatctagatcttattaggcttaaaatacatttattcttcccaaagaggcacttttattgctattttctcttctttcagaatttggtatgcattgtatttacaaacagtaacaaattggtagaaggtagtgtcttgcaaaagagatgcttaaaatatttttaaaacagcaatgtctagaagggagtagtttcacttgtagccttagagggaatgaaagatattttaaataaaaagtgtagtaacaatttatttttctcaattgtctattaattttattagactggtgttcataatcacacttcttgtcagagctcagcctagagtcccactctttttaccttctctgaaacatcaagtaggggctatcttgaggaaggaaacttagtacttattaattagtcagaatttcagcagcaaggaaacaattcttaaaagaacctccttccttatttcttagaatttgtagtgaaagctagtgcaaaactaattctttaacatagcccccttctgttaccttagttactagctgaaccatatgttggaagtctaagaaggaaaggatatagcagtaatcaccaaacttatcagatctttcttttttaaaagcctttttggacaaggagaaagacaacctgacttaaattaaaactggaaaaacattcatctatttgtactgtcttccctctggagtttctttatgtatgtggaattcatggagcaaaattttttaaaaaatagtaaacacagggtggaaaaaaactttcttccaaagttgagttcaggttttattttttgttttgttcttaactaatgttttataataaacctatagccagctagatttctcatcctttgtttcttcccagcaagtatttaaaatttgaaaggacatggtaataggtagttttaccttatgatagaatctttagagcttgattctggtatgtaaaaattttagacccagactttgttgtaagttttttattgtacaggtcaattgttctgggttaggaataggtaactactagcattgttactggtcagagataactgttttattacttagaacaacattatctcctctaccttcccagccccttccaaaaggtatccttttgtactcttcctctgagttgtttgccatcaagcactaaaaacagttgttagtttctgtttaggatgagtacttgcaattagaaaaacataacttgtagtttgtgggagttttgaaataagatatctcttaacatttatatgttttttctcctaaaatttccttgaactttaataattacagatgtgaatataaaacttgttcatgaatttaggaaaagataagatgaaataagcaagctaatgaagttaagatatgtcacaggatctggtttcagatctccttggcatttgatgtctcctggatgcaggatcctttgcaagattaaaaaaaaaattgtaagacagtgttctttttttctgagaaccaacagtttaaataaaattccaagaaatgacaattggctgtcgtaattttagtaaggcataaggtaatatggattgaatgtcaaattaaaggtgtacaaggggtaaatcattttagaaaacctacttgattaaatgcttcccagaagaacaagattttactggattttgaaagacaggcagggaaggttgagtgaagaagacaagggacagtggcattctggtgagcgtatgcacaagagaagttttgggaaccatgtgtagatctgtttaattgtagcagggatgttatttatagattacctatttctctctctcactggaatcttttagcctgttttctttattcttgatattctgtaattatatgaggataagcctcaaattgcatcatcttcccatgtatcagattaacccttttagtttcaagattcatgtatctctttttctgggaaaattgctgctgctttccttttgatacatttccttcatgtttttcctatcatcttctcctgaaacttgtgttactaggatgttggactgcctatatcccctgtatcctagactctaaaaaaaaatgtgttccgtctcattgttttcttactctgtatcctgggagattttctttattttccatcccctaaatggaatcttggcaatcagttttaatttccaagagttgattgtggcattttcttaggattctattcttaattttggatacaaaatagggaatttaaaaattcttttctgttgtttgaattattgatttcctcaaggatcagtttttcttttacctctttctcagtttttttttacatcttataatttttttttcatgtcttgttcttgattgtttcttgaatggaagctttggttatagatcatcacctggtgggcttggctttacttttctgtgagtattttgagagctagctcttaggccaggaatattaccaatgctagaattagtagagccaaaattcaccttaggaagcctggttctctccagatgtgtttgttctctttgaagacatgccccctttttattttaggggaagaataaagaggaaaagtggaattaactagacctttctttttttttttttttttttaagtggcagggtctcactatattgcccaggctggtcttgaactcctggattccagggatcctcccgcctcagcctcccagagtgctgggattacaggcatgaggtactgcgcctggcctagaacttccttatagaaagaagtttaattaactctggtttctaggccttcatttcttctgaccatgaattctctctgatccagtgttctattgggaccatgatttgtccctcatattcactgcatgcctgcctcctaccatgtgttataggttatagttttttctgtttatttttaaaccttttattatggaaaattgcatacctacccaaaagtaaagtggtagatgaatctgtctttactgtcaatcagctttaacagcttcaacagttaatagcatggccaatgttgttttatcttttccttcaaccccttagttttaaccaaatctcagatgttatgcaatctacaaatattttagtatgcatttataaaagataagagctgcttttaaaagacataatcatagtaccattgctacatctagtagaataaatctttaatatcatcaaataagcagatgacctcattagtttttttatttttaatagtttgaagtgaggtctatacaaggtcctgcattctatgcagttagctgatcagtcttttaaactagagttccttctcttgaaatcgattagtttttctttgtgatacatttttatctactcaggcattcagaaatttaattcttttaatttattgcttatttccttaaaaaaaggatttttggggggatcttggaggatgaggagacaacctgaacaggaaaccttgatttttaattatcaatgattaaaattagaaatatttttgacagaaaatgcatattataatagagactcttgtacccactaacattttttcccttggcttttaaaatgaaagattaaactggatagccaaagagtacaaagaaaaagcaaaggaaaaatgtgtggctaccttttaaattttcatcaggtttggattctactaaacactataaatctttttgatactctagggatattcttataaatgtggccagcttgtgttaaaatcatgttgtgtatatgaatttgacaaacagaagtagatattctgttaaacattctgtgttttcatgatagtgagttatggttgagtgctctcagtgtactgagtcgtttagaatatattcagtacaattgttattctgaaagaacatcccttttatcttcataacatatcacaattgtcaagaaaaaacactagcttaaaagttaacactggaaataaatagtggtggatgcagataacattttggggcttaagagttttggaaccacacgttttaagtttaaagtgctctctttagaccagaggatctctaggatttcccttatctttgtttattacattggaacagacagagactcagttgtgctatagaacatctaggagtagtttaaagaggtttcaaagtccctagttaataactaatattcctcgtatttcttgatgagccttctcagtagaactttatcttaaaacttagaatttcttcttctcttggttaaattgtgagaactgtgtcttataaacgttgctgtcttagaattaatgacgaggccgggcacagttgctcacgcctgcaatcccagcactttgggaggtcgaggcaggaggattgcttgagccaagaagttcgagaccaggctgggcaacatggcaaaaccccatttctacaaaaatagaaaaaattagccacgtgtgatggtgtgcgcctgtggtcccagctacttgggaggctgaggtagaagggtcagttgagccctggaggttgaggctacagtgtaccactgcactccagcctgtgtaagagttgagactctgtctctattaaaaaaaaaaaaaattgtttttaaaaagaaataacaatgggtagaaatttaggagtctggatttctatcctggtgttgtcgttatctctgtgtccttgactttatcacttaattctgctctcaatttaggcattgaattagaatagcgacatacactattttatataatgaataggaaggggagagaattaagccagccttgcactgccttctttaaataaagtctcatgtacaaaactgataggctaaaaagataaaggaggaactgtgctgactgaagtgtttgtgaggtgggagagagttttgtagcgttgtctgccttcattccccagaatagtcccaggacatctctggtggatttctaagtgtgaatacctctaatctacatgaatttggaagtttttttctgtctctgaaattttttgaagcaatcatgatactgtgaaatctctgcatttctgtggtggaccacttttacaaaatagcggtaatggtagaagtatttatgggtatgtattaatagatgatgtttaatctcaaatgtgttaaatactatggggtgtgtgtgtgtgtgtgtgcgcgcgtgtgtgtgtgtggctggtttggtgctactgctgcgaatcttttttcttactgtagtaaatatacataacgtaaaaatttttatcttaaccattttaagtatacagttcattgggattaattgtgttcacattgttgtacatttgtcaccatcatccatctctagaactttttcatcttctcagatcgaacttctgtacccgttaagcaataagtccttattctcccttccttctagccctggcgcccaccattctactttctgtctctatgaatctaactactttttaggtacctctcataagtggaatcataacaatatttattttgtgtctagcttatctcattcaaaataatgtcttcaaggttcattcatgttgtagaatgtatctttctccacccttctttttaagggtgaataaatattattttattgttatgtgtatgcagcattttgtttagccattcatctgttgttggacatttgggttgtttgtaccttttggctctagtaaataatgatgctgtgtttgggataatctttaaagcttagatcattgtacttcttaatgttacagtttagggatattcagtcttatctttagtcccacattccacctcagtgtacctgaggctgtggtacacttccataagtcagcaattcactggagaagtgattctcgacagaggtggcagtggtaataggagtggtagaactgattttctttgtgggcccctacccccttgagattcacattcccttcaagctggatgtttatagctgaggtggtggatgctaattctggaatatgtatttgcatagattaatgatacatgctgttgagttgtgtgcttttggtgttataaatcatctttgttcttgaatcagagactgaggcagacattagaagatagccctggttttttaacccacagtacttctaagtgctgctccttgaagatacatctgacttcttagctattgatgagttttccaaccatttctaatcaggcagttatgtttttgagttctgatttcaatcagaatattataaggccttttatctttgcagtatgtatgtttctggaaacttttatctattattaaggaaatttgctatatgaaggtaacttttttcagtgtgtttttttttaaattatctacaactgagtaacagtatgattatattattgttcttgagcaaatttgttttccccagagttaataactgcctcatatatggttcactgtgaatcttctctcaacatagttaaatacatcagttggtcactcagttctccccctctcccccccctttttttctttttttgagttagctatccatccatactcttgctttaatctggagtggttgcacttgaggtctgcttcacagggctgttgccattgttttgtgaatgcctgattctgattatctgtttccgggatttcatctttttttatttttcactttcccactctcattttggtagagtatatattctaagtcttcctgagataagaattctttcttagtagtttttaattatttctcaagctttttgggtgtttgtatgcctgaatatgcctttgtcttttttcagacaggatcttgctctgttgccctggctggagtaaatggtgctatcatagctcgctgcagtcttgaaccactggactcaagtgattctcctaccttagccttctgagtagctggcactataggcatgtgccaccatccctggctcatttttaaattattttgtagaggacagggtcttgctatgttgcccaggatggtctcgaactcaagctatcttcctgcctcggcctcccagagtgctggaattacaggcatgaaccactgcctggccttgaaaatgtctttaaataaataaccctcataatagatcagcagttttattgggtatagaattctggggtagaaatttttctccagaattgtgtttgtatttcgacaatgttttctattttccatggttactttaaaaggttagatgtgactttgattcctgaacctttgtatgtgatctcttttttcttttgtgatttattgtggggatttttctttttccccacgttctgaaatcttgctgtgtttgcattcttcccccccacctcccctcttcccttttcccagtcttctccctcctttccctcctccccttacctttctttttccttgtagtttgctctcagtggactctttcaatctagaaaccactctttcattctaggaaagacaatttattattattttattcatctgggatgtgtgttcttctgacattgctatattgattcagtgaaatcccatcagacttttaaaatatgtgtaatgtgacattttgattctaaaatatgtatgaaaatgcaaaggacctagctaaaaacaatttgtaaaacagtaagttgggggacttaaaacgacctgatttcaaggttatctgtaacacagtcagcctacaagtacaacctgcaagctacagtaattaaggcttggtggaaggatattaaggataaacgaatagatcaatgcaatataatagaaagtccagtagacaaacacacatgtatagtcaatttatttttgactgtggtgcttataatattcagtgggaaaaaaataggcttttcatagtgatgtaacaaactggaaaaaggtttgaaaggataaattttaatttctacttcataccatatgcaaaaattacctcaagatggatcattgacctaaaagtaaaagcaaaaactctataaagcttctaaaagaaaacatccaaaatatatttgttatctggcataggcagaaatttctttgataggacaaagaaaccactaaaaaataataaattggattttatcaaaattaaaaatttctgctcatcagaagttttttaagaaaataaacaggcaaggccaggcgcagtggctcatgcctgtaatcctagcactttgggaggccgaggcaggcgggtcacttgaggtcaggagttcaagaccagcctgaccaaaatggtaaaactccatctctactaaaaatacaaaattagctggacatggtgtcgcatggctgtaaccccagctacttgggaggctgaggcgagagaattgcttgaatctggaaggcggaggttgccgtaagtagagatcataacactgcactctagcttgggtgacaagagcaaaattctgtcagggggcggggggcggggaggaaagcagggaggaggagaggggaagggggggagagagagagagagagagagaaagagactagaagaaaacattcacaatgtatatatatatatctgacaaaggacttttgtatatataataaaccaaaactcaaaacaacccagtttacttttttgtttttgagacaaaatctcactctgtcaccaaagctggagtgcatcatagcttagcctccagagtacctgggactacaggcacattacatcacacccgactcatttaaaaaaattttttgtagaggtgggatcttgctatgttgcacaggctggttttgaactctccttaagtgatccccctgcctcggcctcccagagtgctagtattacaggcattgagccgctgggccagcccaaagaacccaatttgaaaaatggtttaaagactctgatagacacttcacaaagaaggcattggaatggatgataagtatatgagaaacagccataagaacattagtaataagagaaatgcagactaaaacaaaaaggtgataccactacacttccacccgaagggctagaatttaaaagaccaggcaatatcttggcaaatatgtggtgtaagcagaattctcctatattgttgaggaagcagaaaatggtacaaccactttagaaaactctgctaggtttttaataaaatgaaacaagcacctgcccctgacccagcagtcctaccttttgttatttgcctaagatgaaaatactctcagaaagatttgtaagtgaatgttcatagaaagtttattcagaatagccgccaaattagaaagaacccagagtgttcaataatggaagaatgaagaaacaaattatggtatattatttaacaaaatactcttcctcaataaagtggagaaaatactgatacctgcagtcatattgatggatctctgaaaatgctgagcagaagaagcgagacacaaaagagaacatactgattctatctctatgaaatctagagtaggcagaacagatctgtggtgattgaaatcagatcagtgcttgcctctggaggagattgacaagaatggcaccagggaaccagggaattttctgaggtgatggaatgctctgtatcttgctgtattttgtgaaatagaaaggtgtctgcatttgtcaaaactcattgagccacatatgcttatgatttgtgcatctcactctatgtaaatgatgcctcaattttaaaagcaatcctgaacaataacaattatatatatacatatattattattattattattattattattattattggtgtttgttgtttttttttttttgagacagagtcttgctctgtcatccaggctggagtgcaatggtgcgatctcggctcactgcaacctccgcctactgggttgaagtgattctcctgcctcagcctcccaagtggctgggattacaggcctacaccaccatgcctggctagttttttgtatttttagtagagacaaggtttcaccatgttggccaggctggtcttgaactcttgacctcaggtgatctgcccgcctcagcctcccacagtgctgggattgcaggcatgagccactgcgcctggcctaatttttgtatttttagtagagatggggtttcgccatgttggccaggcttgtctcgaactcttgacctcaggtgatctgtctgactcgcctcccacagtctgggattacaggcttgagccgccgtgcctggccagtaacaataaaaattatagtgatagatttttttactctcactgagcagtatttgtggttttctgtccttgttctcaaagcacctatgtatttcgacaatttagatgacttgatgaatatatgaacactgtgcttttaatgaattcagcttttatgcctgtggaacaatactgtgataaattttatttctgcccatgtggtttcccctttcataatgtttgaaagaaccctagagtgaaatttttaagaaggttatcaagtttcttttgagaattattctagagtatctgttgcaccacatcaggtatagtgtacccctaagtagctagagtcccctaaaaagttgaggggatgtgtttttagtgtgctttaaaaataacatttactattgtttctttctttctttttttttttttaatacagagaaagtataaagaagaaagccaaaatggcccattatcttatcatccaggtagttcatgttaccctttaaaaaatcagtagtacctgcttctggtaagagaattcagttggtgcagaaagttataaaacaaaaaatcagcttcatgcccttaatatttatctccaaagataaccctgttaaatgtaaaatgccttgcagaaaagcttattatatgtcagaatacataatttatatagatccttaaagaatatttacacacaatagcagtttttttctgcacttttttgtagcttgattttttattcacttagtaacttagtacatcttgaaaatatttctgaattaacacatacccttttcctcctcctcctcttcttcttcttctttgttttttgagattttctcactcttgcccaggctggagtgctgtagtgcaatctcagctcaccgcaacctccacctcccaggttcaagtgattcttgtgcctcagcctcccaagaagctgggttttaggcatgcactaccacacatggctaattttttttttttgagacggagtctcgttctgtcgcccaggcgggagtgctgtggcgtgatctccgctcactgcaagctccgccttccgggttcacgccattctcctgcctcagcctcccgagtagctgggactacaggcgcccgccactgcgcccggctaattttttgtatttttagtagagacggggcttcaccgtggtctcgatctcctgacctcgtgatccgcccgcctcggcctcccaaagtgctgggattacaggcgtgagccaccgcgcccggcccacatggctaatttttgtatttttgggtagagatggggtttcaccatgttggccaggctggtcttgaactccttgcctcaagtgatccacccacctcggcctcccaaagtgctgggattacaggggtgagccactgtgccccacccacatacctattcttagttatatagtattcattacattgtataggtgtattatatatttaactagttccttattggtagctatttagattattttcattgttgaattaaaaacaatgttttagagaacaactttgtgctggtgaaatgtacttttaaaaattaaccaatgtttaattcttcatagattggtaattttcagcccttttcttgtcataggagagactggaagtagctgtgttttctcgaccttgttactgttgagatactagattggaaaattctttgttgtgggaggccgtcgtcctgtgcgtggtagaatgtttagtgacagccaaaatgtctccagacattaccaaatgaaccttggagtgcaaatttgcttcttcttaggaccactggtacagcgggcactgcaggtttacacagatgaacctttttcctgactgaggagctgcagaagtcagatataagaggtgtattccttggggtttgaatggatgccagaaaaggggaatttggggaatggctatagggatatctcatagagtccagggagaacatcagagctttgggagcaagtcatagttgccagaaaccaaagcaatccagtatgtgttctttcatacatttagcaaatgtttgttgaatgtctgccatctgctagttactatggtgtgggcataggtatttcatgttgaaaaaagagatgtgattgttacttcatgaagcttgagatttagaggcagacacagacgtgtgtgtgtataaaattataatcacctacttgctattaaaggaagagaaccaggtgctatgagaaaatgaaatatgggcctaatttagaaggagggtggtgaaaatgtagtcaatgaaggcttctaaacttgagtgagttttactagatttggggaagggattgatgagtgttccaagtggaaggaatcgcatgtatttgaaattatcaaggtgggaaatattcaacttgtcatggaatggaaggaatggcagttcacatggagggtgactgaatgagaaaggaaaaacaaacaaatttagattaagggtgtagagacagttaggtatggagagatgggccacataatgtagggccttgtagataaagagctggatgacatccaaagtgcagtggggagttatggaaaagttgtaagtaggtcagtgatttacaatttaaactgattatttacagtctaaagtaattattctggctgccgtgtggactatgtactgaaaggaggtaagaatatagttagggagacctgataaaactatggtaatgtaggtaaagcgtaatagtcacctatcatgacttcaatagtattaaattgatgacagtacatgtagagagactgtaaagacattttggaagtaattaataaatattggtgataatttgaatgtagatgatgacaaggaggaaggtgttcatagtgacttgtagaattctggcttgaattaatgggtttagttgcgattactgtgatggagactactgggtatggagcatctgtaaataggggtcatagggcaagatcgagttttagataatatttaagtttgagggacctgtgacattttattagggatatcaaaacatacatatatatattatatatatatatagcgtgtgtgtatatgtatttatgtatacatgtgtttctgtgcttatgtgcatgtatcacatactctggtgttgaaaatatgagtctggtgccagaagtgaagttgtagattggagataaaaagttgaaaattgctgccatatagatgaaagggttgcctaggaagagagtgagaatgtattttgatgagaaaattgtgtccagggctgagccccaagaaaatctaacatttagaggttggatagaagaggagggacaggcaaaaattaaaagatgcttgataattaggaagcaaactggtagtgcatgatgttatagaaatctagcattgtttcaaagtgcagttgggaaggaattgtggttggctatgtctaatgttctgagaatgctagtaaagctaccttgttggcaaaaactcctgagatacactttaaactactcttaatttcttacttacttgggaagaggttttagctgccactggaaattggggcctaaacagggaaaggatctcatgaaaacatgtaacctatagatttagggcagttttccttaccttttcttgaagaagcatagcccagaaaaactgttctaagggtaaacttagagtacaactgacacaggatcagctcttaggaaacagtcaatagcaacatgatgcaaacatgaatgtttgtcttgtcctctttaatgttactcttttctgtggtgataaaacatttctttgtatgtcataaatcagtactacttcagaatactgcagacttatctaatttgtctaatacattctgttcactaaatatgagtatcagaatttgaaattttctatttagaatgtttgagccattcttctggacatttcatttttcagtttttccttttgcctcatcttagatcacagcaaagatactcatttgttggtagtgccaggaagcaggcagtttccatggtaactgacagaccgagtttactgtggaaatttccggaattaacagagctgcattgcagaaggatgcataaagcagtattcatctagagatcgtaacagtacggacacagaagaacagttgcagtgatgtgcagggtatgtcttacctttattttcctgtctaaggaagattagtcatatatatatatatatatatatatatatatatatatatatatatatatatatatatatatatgcatgctgaggagacagtaaaacagcttggggcgttttagtatatgctggcttgatacagtcaaagttgcttaggaaaaagaaggaagaaatgatttgggaaagaaggtatatttgatagcattgggaagaaatcaagatcagatgatcgaggtagaagaatgtgatagtgaaataagaggagaaaacatacttcaaactaattaaataataaaaggttcttacggatagtggttctaggcacaagaagatatttatttatttattgaaggaaaatagtagacattgtcaagtttgagaaatcaagttctcatgtgcaggaaaaagaaatctgttaagataattagctattacttgctgaaagataggtagatatgagagatgtccaggatattaaacaaggaggtttgctgccatcttagcgtacttacctaagtgatgagagaatcctagaagggtttctgcccctaattccactctctgttgattggtgggccattttcaagaaaaattctgaaatgtatcttgagattaaattctggaaacagaactataggatttgggcagataattgaaggtgcttatcatatagagcataattataaatgtaaaagagaaaaaggatatagaaaatatgatttagattatttgcatgatagatgcaatttaggttgctagataccatttggtatcatttatatcatgtagtcagcaaactacagctcatgagctgaatccatcctgtttgcttgtttttgtaagtaaagttttattggaacatagccacacccatctggctgcatagttgcaggagactagtggcttgcaaagcctaaaatatttgctatctggttctttacagaaaaaggttgtgactcatgatttagatggtgtactggatttttcaaggcttctgtgagattaccacaaacttggtggcttaaaacaacagaaatttattctctcacagttctagaggccagaaatctgaaggtgttggcagggccatgcttctcccgaaggttctgggggaggatcccccctttctttcagcttctggtactgctgctcttccttggcttgtggcagcataaccgtaatctctatggtcttcttccctgtgtctgtcttgtgcatctctatcttctccttttctttgtttggtctcctataaggatagttattttatttagtgcccacctaatccagaatctcttttttgagatctttaattttatccgtaaagataggttactttctgagattctggatggacctatcttttttttgtgtggtgggtggtgtatagttcaccctactacagatggtattgaagaactgggttttggcttcttaaatcacattgtatattaaggatagccagttcttagtgtttcctttgacctgctggagaagatattaaactcacatttcaaaggcaaggtgatagaggcatagttgaatcatagaagatagcctttgtgacacaaacataagcagtagagtaaagggagtactagaaaattcataggagaaagagtactaaaatattcactggagacggatgaagaccagtgcctgatgcttcatatcgttctcttcttgtctcttcatatttttctcaccctaactcccacctccaaaaaaacaacaaaatgaatttgaaattttaatgaaaaatggttggcacaaaaacaaaaatcacagttttgaggaatggctcatcgctaaattacggcactgggaaatatatatatatgattcaaaagaagtagacttaataagcaagtagaggagtggcagtgtagaaggtacacaccaatgtatagaccagtgaacctgagatttggcttttgttgagagcctttttgtcattgtgggagtatacaaactattggcctgggcaggagagaaggtctgtgacattttcctcttctcatatgggcatatttgtaaaccataataacagtggtaggtatctatttgcattccctggaagtctcatttactgtatttgggtatattctgaaatgtttaaaaagtgatgaattcacatggtgaagaatcaaatagtaggcaagggattccaatgtagacgctggagctgcagagaaaagccaccttatattgcctatattctcacctgcgcactttgaaatgaagcttctgatacagacttcatggagatgatcatagaagaattaaatagaaatggttaatccaaattagggttcactaagagtaagtaagcagttccaaactagcctaatatacttttttgaaagtgttactaggactgtagatcaggagtttggaacagactaggtgtatcttgatttcaacatttatgggcacagaggaggaacatgaagcccaatacagtattttcaggaagtttcttagaaggacaagagtgaagtctgcgttttctttctaatcaaattctgttagtctgtgaccatgtatattctgaatatcaaataggaagccatgggaatgaaagttttcttattttcttcctttaacaaaacatttgaattgtatgcctaaataccttcatagaaagatacaaattcccttgaatccaactacaattagacttttaacttttaatttttctgttagtgtcatgagtatatgataagaatatcataaggaactagaataaaatcaggtataaagcatagattgggattaaattgagctggttgatcatagttcacatgtacaggctaaaatttaagcagtataaggtactcatgaataccctagatttcaggtctttgtgttatgtaaaatacacatgttcctaaatgtgtctatacataaaatttatttctataaaattgttttccttttctcatcgacatgtttaaataagtgtctcaaaaataataaaagtaagcttgagggtgtttaataagtaggtgttcaaaacacaactcacatagtattaagaattagctaacagatcacaaatgaaaagtagttgagactcttggtttttaatttgctttaagaactaaatttctgactttgtaaaagcaatctgaggtttgtagtacaaaatgatatatgagtagcagtgtcctgctaaaatatttattaagaaacaaagatgaaaatatgaaacactgaaaattaagatgacttaactccctataggatctgataatggatactaatagtaacacagccagaataaggaaaatttttacccagggattcttttatagcagagacttcatcccttttcatgttcatttcttctcctgcccacactggtaactaccagaaaaaaactggggagagatgggaagagggaggatgctgatgaattttatctgggaagtgtcattatgagtgaagtgtactaggtggaagtagagaaggattgtagtaacagtatagtgctgcccagtatagacttaggattgtatttttatattgctgttatcagtccagaatacagtattagagaccaagaaaattggagagaggagaatttaccatgggagcagtgagtgctctgatttgtaatatactaagccttagatatctcaaatctgcctttgaaccataggcatgtaatgggcaaatccgtatcagacaagtagagtgcagcccaaggataatcttctttttctttctctccttctctcagcagttttattgaggtataattggcatagaataaactgtacatatttaaagcgtataatttgctaggttttgacatatgtgtacatctgtgatgccatcaccatagtcaagttaacatatccgtcattcccagaatttcttccttctcgttgtagattttttttttttttttttctgagacggagtctcgtactgttgcctgggctggagtgcagtggcgtgatctcggctcactgggaacctctgcctcccgggttgaagagattctactgcctcagcctcccaagtagctgggattacaggtgcccaccaccacgcccagctaatttttgtatttttagtagagacgggggttcaccatgttggccaagctgagctcaaactcccgacctcgtgattcgcccacctcggcctcccaaagtgcggggactacaggtgtgagccactgtgcctggcctcttgttgtagtttttgtgtttagacatttgatttggttattttttctgtcttccacgtctatatttaacatactctatccatcctttcgtttttttaatatatggaacgtggtaaatgtttcattgtctttattctagtatttttgtcatttctggtcagttgcaattgattgatgtttttctcttcactatgggtcatgtttttctgcttttttgtatactgtggtaattttagattgcatcccagagattattgtgtgatggctgtttttgtattttcatgaatgtttttgagttttgttctttggttaagttacttggagatagtttgatcctttcaggtcttgctttttagctttcgcagatgagactactctagagctaattttgccttactagtaaggtaaaatccttctaactactttattggtttccaatcaggaagctttccactccagtggctaagaataggagctgccttgtatgagcctgggtatcatgccttcttaatccttttaggtggcttattcttcaggcttgtataggttcctcacaatcatccgctgatcaaggagggccctctgcatatcggtggggttctctttctgtgtagctgtctcttatcctgtactctgccatgtgaactttggctaccttggtctccctagattcccagatccttgtccgcaactcaagggtactgccaggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctatatattctgtctgtttttttcagttgttttaggtatgagggtaagtctgtctcctgatacttcatagtaggacaagtggaggtgccacattgacactcactgtgagatggaaacaggaattgtggaactagggaataatatcttgaagactttgagaaagagcatctccaaacaagatatcttgcaggattcaaaatagtttcttacaatagtgactgacattgttaatacagtgaaagaagtcatggcgtttataaaaatggattggaaaaatctcgaggagagaacagactggatggatacgcaacaagattatagaaagggggcagatgaggaaaagacataactagggacctgaaaagcagtggtagagtgaaatcccttttgatgcaattgtgaatataaatgatactgcatgacagcaaaagaaaagaatttgagggcagtcattgatttgaaagcatacaaattactgaattttttaaaaatgtaaattcataaacacaagggaaggtaaacaacaaactgggaaaatatttgcaatgcaggacaagggttgatggtgttaataggtaaggaacttgttagtagaagcagcgataacaaaacaaacacctgggccaggaaggctcaggggcgctatctcaggcagttaataataatacaaaaaagacatatttgttcaccagatagcttaagaatgttcaactctagcagttgaaaagaatgatctaaccctaacacctttcaaattggcatgaggaaaaaggtgctgttgactaggtacagtgggcaccttttggctgatagtactcctaaatcagtgcagacttggtacacagccattccagtagtgataaccaattatttaatgactgtgttaaaatatattaagtgaaatctataagcagtaggtataatatgctgtttttgcaacctattcccatagtatacaaagatacaaaataatatgtactaaattgttaatagtggtttttttctggattatgattgatttttccattttcctttttatcttctacctttgtagctttaggagggattttagattcggtgtctggttggaaaaagaggttcaagtactggtactgctgctgaatttgcacagcaaacacactgcatctaatagagggtgggagtgaaggtggaggatgtggctagagctgttctaataaccctacttgactggccactgtgtttctttacaaaacaaggccacctgcctatatatgaagttccaggcagctttattagacattgtatagaaatacagcttttctcagtgtccagtctgattaatgttctgggacattatgtcacagttctgtgtgtgtgtgtgtgtgtgtgtgtgtgtgtgtgtgtgtgtgtgtgtttagtctgtaggatttcagaaatttcagactagtagattagtctgggtcaatgaagggacaacaactaaaatacagtagtgttaattcagtattaaatttaagttaacagatatatttgtcatttctatccagaagataaattaataatcgggaaggacttcactgcaaacatgtagcctcaaaaaattagttttcagattttaatctaacaagataaatctctgatatcaaaatataatttctgtacattgagttgtacttttaataaggcctgtattatatgaattcatgccctatattaagtattctatctataatcttgcatgtttcgcaaaagttaggaccattcatatttcacttcttttgaatgtctgtaacacctgtggcagtttttctgggtgtatgtgcatgtgttttctctagaatgtggaactgttaagtctctgggaaccaagaattattagatgtggaatagtaaggcactgaaatcagggacaccagagttacggattttttgtgtgtttgtattttgtgtgtgtgtgtgtgtattttttgtgtgtgtatcttaatcaaattgtattgctttattcatgtgttttttgcagggtactgtggtatggactagagaacttggaatgacttatgaagaaaccttggaatgacacatgaaggatgataggaaagtcattctgaggcaggatgctttactgaattgtttttaaccagggtatcaaacatcaggaatgagttcaggagaacggaaacatcttaggtgctctgcatgttcagagaaacttctctagtaatgaactatagaaatgacccctgaaagtatagtcttagagttaagattctattcaaggaaatacttttggcctgttgctggaactgctctgtggatttggagacagttagcatcattggcccccagccactaaatgctgcttgcacttcccagtgattgggatgaccaaactgctgctgatgctggaggtgtccgggcactacctcctttgagaatccctgggaaataaaataatgctaggggctgtattaattaaaattaagtttgtttgcatctaaacaacaacaaggataggaacaaatagtggcttaaaccagatagtttatttcacttttccatagaaaagtccggagataagcaggctagggttggtgtagtagcttcactgttattggagtcaatgctattttctgctccatcattctcaggacattatttcagttctgcagggcattgagtgtggctggagctctagtcattacctacattccaggcaacaagaaggaggttggaggaaaagaaaaagagtcttttttccaactgagttagctccttttaagtactgtgttcctattttccacctctaactgcaaggaatgttggtgacttagcttggcctgcaaaataccacatactaggtggcttaaacaacataatttatttctcacaattctcgagactggagagtccaagattaaggtgctggcaaggtaggttttaacctgaggcgtcctgccttggtttataggtggccacctctcactctgagctcaagtgacctcttgtgcatatgagaagagagtgaactctgtggtctctcttcttgtaaggacactaatcccagtggattagggccccacccttcattaaccttcattgaaccttcattatcttcttataggccctgtcttcagtacagtcacatttggggttagggccttaacatgtggattttgagaggaaacacagttcagttcatagtagttgggaaatgtagccttttagctgggtgcattgctgccacacataaatgaggatcctgttagggaggatgaagaggagaatggatgttgggtgacagctgatagttactgccacagcggctgttgtctgagtttcccaggttggtaatgagaaccttggggttggaaccttatgtagtgttcattggaggcaggtaagggtgatctgtataaaataatgcacagaaaattatgaagggaaagatgagggatatttaggaattatttttattttggggggtacatggtgtatatatttatggagtatgtgagatgttttgatatgggcatgcaatgtgtaataatcacatcgtgggaaattgggtgtccatcttctcaagcacttttcctttgtgttacaaacaatccaattgtactaggaattatttttgataaaatatagtccccattctgaagaaagtgatatcccaaggaaaagtcagggaactttttttttctttaagagtataattgtaggcaaatatttatgaacaagtaagggcaactttacatctttattggtttgtatttttcaccaatcttctcattgggtgtgttttctactgtttatgttctttctttcctaggcctcttacgtagtttaggacagaaattgattgactccagagtttaatggaaaggttctggtccagttcctgtatctagtcagtccagtgctgtatctgtgtatagtcctgtggaagccattgtggttgtacctactgttaaagcaattgctgtgaaatggactcagttttgctggaaagatcgctagcccagtataaagacgaatgtatgaacatgccttggtgatgtcataactgtggcatgtttttctgtggtttttacagcactttttctttctaaatgagaaacttggaactctgggtaggaatcacattctcctcttttagcagctttgctgagatgtaattcacatattctgcagttacacatttaaagtgtatagttcatttgcttttagtatatttagtatatttacagaattgtgcatctgacaccttattcagtttttggatattagcccaagtaggtaccctgtatcacttcgctttcaacttattcagttttaaaaagaaactacagtgagctaaactattagtagagatattccataatactaaaatttgatctttaaaataagacataatattgtaactgttttcattctgtaatttctatatagtaatgaaatatctttcatttcagttctcaagaatgctagcataagtattatatagcaatgtagtcatgagagtcatattatatcatctttaccatattctcttggttagaggtaagtcacaggtcccactcacacccaaagaaatatgcctacacaaaaatacgaacactaagaaggtggggatcatgaggacttcctggagcctgtctgccacagcccttcaattagcgaacactgtaaaaaattttgcttctgatttacaagtaattttaattaactttttttcagcttccctcagtggtagattggtgctgtatatttcaccagtgattttgccattgagatagtatttacttgccaaagattatagaacaataatcattatacatggaacttcttcatgttagaacttttttcaggcttaatctgtctacttcatgaaaaagattaccaagaagagtttcctatttttgcctagacctgatttccatcttaaaagatcagttccagcttcatcttcacctaaatggtcacttatgccactgatttccgggcttcttgtgattctggatgctagagtatcaaataatatgggtgaaaggactttgaactgaaaagcacttgtatgaatgaaagcttatcacttagtatgatttgaaagtctgttatttggaacactgatttagtaaattgttatttagaccaagtgtatgaatctttgaagtgtaactttgaaccttaatattagtacatacgattattctcagagtgggggtagattttaaagttctaagttttttgggaaccttaaaggttgctacagaaaaccattctactaattggagaaaactttcctaaattttggaagaagaaaaataatgaccaagcacataaactttgcttgtttgcatcataggatcagagtttaaaagagatcctgatcatttagtatgaaactgaaaaatgtagttgatatttaatgaattctttcattgtgtgtatggttgatagtttgttcctacacattggggtttggtgtgtgtgtgagagagagcaagagagagaaacagattgattttacatttttcattggatttacttttttacaaagcatggttagaagttattaatactttgatctccaggttgagattttggagatgattttttatttaatggaaatatgtaatgagtgagctcttttgtctacgagccactcattttttatcccattgctttatcgaacgagggctgaaaatttcaattttgaatagcacatggcaattttcctcttagagccagctagctattcagttaactgttctcccacctcaggatggtattaacaagaacaggacagtatactaaggcactagttcccaaacattactggaatcatctgggggtctttaaaaatactgttttctgactcctgtccctggataattcagatgtaattgctatgggacgatacctgggcattgagatttttaaaatctcccccaggtgattgtaaggtacagcaaaccttgggaatagttgtactaactgaagattgaggcactggaataactaatgttgggtaagatagggtaagaactttttcgcaataaggtttgcagctcttgggattctcacttgataatgctgtttggataaaccatcatccaagtttgaataagatcttatatttagaaatgaaaactgatctgcagaattagtttaatcaataaatgggaatttttaaaaatcttcttggcaatttgtttttatgaatcccgttgaagctgtgtctattgactacctaaatctagatcattcttaatccagtgtgtaaaaaaccaggatgacacaaatgaaaaacttcaaaaacctggaggtcagactattttagtaatttagaaaacatttttcccacacattaatcagtactaaaagaaaaaagttaaaacctatttaaaatgtggaaaaattgcttcccaatattttaacagagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaagtaggtgatgccatgattatttttggtactttaatccattaggtgaaatttcatggtgcagtaataccactgttgttgtgttcctacttttgtggtaaatgtgggtgtttaaaaaattgtttctccaactcctttgagggtgttctgtgtagaggtttcttattggtggcacattttctatctctttggaaacatgagtgtatgaagtgtgcatgttgattgcatttttggcatgatgcattaacatgttttaaacttcaggcccttctactgccaaggtgagttcaggctgggcggctgcacccctgggagcagggcagtgctgcactgagccaggcgggagctggaagaagacgcagcacactgggttgggcaaggtgcggggctagggctaacagcagtcttactgaaggtttcctggaaaccacgcacatgctgttgccactaacctcaaccttactcggtcctgaccggctcggcttctgtttgtttatttcatctctactcagtactgccctgttccctggttttaaagttgtactgaaatgcataccttgtgataatgttgtcacattttgtccttattgtgtcgtgccacttaatatgttcattaaaaaaaaaaaatggccagaaacagagatttgatccatagacaatacctggcaagcttatgctggtacctgtaaagaactggtggtttccatctgactcctagtttcatgtaattgtaatttattcatttgtttgtttagatgtttaacaaatctttgctgtatgtaagatatttcaggaaaatcagcaacagggggaacaacttgcaaaaacaaaggaaaaaaagctagctgtggccataccctctctgagcttaaaattcctatgggaacaaaaatgtttcagtttacaagaattcagaatggatttgcatatagtccaagctaatcatcttcctattagtgtcctattttgagagtttgtcagagtggttgataagagtccttagttttttcttgacatttgagaatgaatttaaattaaaataaaatgctttctgtgtagaagtctgttgtgagccaaaccttactgtaactattttagtatccttcactgttgagcatttctttttgctgggtcatatgaaagtaatgttaaattagtggtagggaaaatttttatgattctctctatgggttcctaacattgtttttggctgtatttttaaaatgtggtgagaactatagacttttcataggcaggtgtatatacacaacattttgtatacaaaccgtagacctctaaagatgcacaggtgaagaactctgcattatgtgttaaaataaaatgttttattggaatgtgaaatgatttctgtattcctattttgtgccactgcagtgtaagtggaaagagtcattttatttagactcctggatgaatgttgtgttgtccctttgtgctacctgtgtgtgacatccagttttagttggctggatcttaagggaaaggtttcctatatagttaaagttgtaaacttttctttcaggtactagggaaagtaattttaaaaaattatttcctgctttttacagtttgtgttatgtgtgcttcaactttgttgatgaacattattaaacattttagtaatatggattgattttagccattgttaaaaaggtcataaaggtaaagagggtacttccttttgacacttaaaagtttttctcactgattaatttgataatattttgggttgtataatgcttactcaagttttgtaggaattcaagaatgaaaataggaaattgttgtccatcatttgtaatgttacattatcagtggctactggctactgtgacagttccagttgggatgctattaaaaatcccagctgtacttgaagaactttcaaggcagtcatgagacctacaaactggttgctgtcacatgtatacccaccacatggtactacctagcttcgtttaccatctcgaattcttgaacaagcatagcagttggggatgggagaggatggcagtacaacacatcaattaacatatagttgaggagtacctttggattccatgacttcattaatactggaagaataagtgtttttgcattaatatgcattaaaatttgataccaattgatgacagatgtatgccatctctgaattaaagaatgcatttattattggtttcttcaaagaagaatagtctttcatcacacttgagagagttcattcattcctcatttaggtacattgactggattgacaggcacaaatatacagaatcaatgtatgattaaggaggtgtttgatttgagactttacggttttaaaggaaccatgagacggtggttcacacagctgagagctttccattgctgttggtgaaatgagaaacacgcttgaagtaactctgtgctaacatcttaatacacactttgagaataaagaaggattgcattattagatgttaagctggaaatgatccttaagatttacttgcaatatctgtagaaaagtgaactgtgatattagcttgatttttttctttgtattattcctcatttttagttctgaggaattccttccccaaatttattttgccatatataagaaatatttgaaaaaggtgacttcttagtaaccagagttaattaccccaaagacttaatctaaaaatcagttttgatataatcagatttagtgaggtaacattgtaagagttatacttaaaacaattttttgatgtttggtttgaggacagtctcccaagctatcggtgagtttctgcattaggacctaagatgtgaacatggtttaccctttagttttaattgcacgtgcttgggaaaagggtcttgctctcctgtgagtgggagtaatttgtatacttgtgcctgaatgactagtcttagggctgcctagggcaaagccagtgttgcctctggggtttcttaaagctcagggagaacaaccttcaactcttaccagggatttacttctaactgtgatcagtatcctttacaaataacatttatttagtgtcctgttttgcacggtggtggggtaaccactgaatgaaaacattagacatgaacagtcactgtcctctacataaagtaggtgcctgctcagctctctggcaggtggaaatgggagaggatggcaatacaacacatcaattaacatatagatgaggagtacctcatctatatgttaaccagctctctggttaaatgtagcggggtaaagcccagagttcagaccaaatgtttgaagaggcagttaggattaggtttctgagctagggtaattcagatctgggagaaacacctagcatcatcagtcagaatcaggatgccacagaaaatctagggacacaggagaaaagagagtaaatgaaatgtcacagcttagaccatgggcttacaagctcagatggctgacagagggaagaatgactgtaagcctctgatgcctgacagtatattctccacctgactctgcctgcagtgtaaaaaatcctgcatgcctagagtaccagcttccctgttgttttctagcagactcatgtccagattgacttcttgaaggtatgcatgcccttttcatgtttgtagaatatgtgcgaaaaaccaaagaaacgtgaaaaagtaagaatgaaaatgagagggagtataaggactgaagtacctgtcactaaagatgatggcaggcagtggaatctgaattgttgtgtgaagggttaatactgtaataaagctgtcatctcattgaagaactgaataatattgagcaggtaggtgggaataagaatgtgtcatgttaaatttgtcattgtggatcattatgatgacttttcagtcttctgcttgagaaattatctgggttaatcaggaaaaacagatctgttgtttgagggtaggtgcataggccggactgagttagcaatgtgacctggtatgcaagagtttcaagtattttctttctgttggagatctgcctaacttgtcttgttcttttgaacctcagctctaccctttcacctctactgtttcattgatgtgagtcttgctgattctggcctgttaacctgattttgattcctgcaatcctgcctctccttgattatttggattttgactttagtgtccttgacctggagttgagacccagcctaatcctgatgcttgatagtaaggactagagccctctgctgacagtatcagcagcccacagctcagctgttccctgagtagaacggaactttaatctgctggttgagtaggcctccctggtgtagatagtatggtgagtatgggaagtcaggtatcagaaaagtatggcttggcttgttttcctgccactggagagaccatgccacttctgtcaaaagttccattaccaaattatttcagtggggattatgatgatgaataatgatttgaggaggttcattttagtgtttaaacattggtcttgcatgttctgaaagcactagaatgatactgggatggccttcaattggaaaagttcctttttgatggcatagagtgctttgttaggccattttattcacttccaaagggccgcagtgatcatatttgattatccaaatcacctatgggatgcagatgtcatggctcttttgtttagaattgagactgtagtctaatatcttaggccgtcgttcggtcagatcatgtgacttacttaaggcatctgtgattgagctgtattcttttatgcttcctaatattgcttaaaagctgtggtggtcatatgaaaagtgtaagtagagcatttccaggaggagacatattcaaggggtgtggcagggctggcctctaggcagccttgattttgaactcaggttgcttatgtagatggggttggaattcccagtatacatgtgtgcttgttttgctgtcactccaagttaatgtttttcagactgtgagtttgttccattaacagaattggatgtgcaacccaagaaataaaacagccaaaatcagtactgttcggggttatgtgagggtgggaagcagactctacctgcagccatattggaagcccttggggcaccagctctgaggaattaataggggtacaattaagacagtttggaaatggttgctctaggtgaattttagtcaatcattatatgtttttgaacattctaaagatctggtttctgaaaccttctaccatcacttggttaaactgaatgaattttgacattggactaaatcccaacttacatagttatctggagaaaaacctgttttttgttttgttttgttttgttttgttttgttttgtttttgagacagtttcactgcgtcgcccaggctggagtgcagtggcacaatcttggctcactgcaacctctgcctcctgggttcaagtgattctcctgcctcagcctcccaagtagctgggactaaaggcacgcaccaccacacccggccaatttttgtattattagtagaggcggggtttcaccatgttggctaggctggtcttgaactactgacttcaggtgatctgcccgcctcagcctcccaaaagtgctgggattacaggtgagagctaccacgcccagccaaaaacctgtcttaccatacctcactctgcgtgggtgtcatttgaaccagtatgtgatatatttcctgcatattttctatcattctttgtcatcttatggctatgcctctgaaatttgttgtatatgtcagatttctattgttacctcactttattgtcgtaagtactgaaatgatgatctgtcatttatggtcttcagacccttaaaaatttcagtgctaagattgacattgtttctttaaatgtggatgatgtggttagtaaagaggaagaagatgataccactcttaccaaggcatgtcaaacttgttccattaacttggtcctcagggcagctcttcccataatgtaatataacacatgcttttggaactgaactcccaggtgctctgataatacgtagcagaaggtaaggtaaaaggaattaagtggatctcagtatccccagtgagaagaatggggtattactattaattaattaattaattaatggggctaagatacaactgagagtttattaaattgattttaaaagacttgaatgatttttgcaattaagaattagcattctttcttctgcccgtagtaaaatcatatatgctttcacaatttaaaataattgacttaacagacacttattttttcacaggaaagaaagatttacatctgtgatcagcattctagataatttgcttgcttcttttgctgtttgttttggttaatgttgccatctgctttgaccttattaatgatggctttgtgagatatcatggccattttcgtgtgtgatctatttagaagactctagctgataaggaggaactcgtaccacaaattaggaaaataagaatacctaagattttctgcagcccagaggaaggtgataggatattgatgtgctgctatggtttctaggattttccaactttggtttctaggattttccaactttgtattacaactgaattctggacatttttgctgggaaagcagcatatttgtagggttcagaatagtagggacactggaggagtgtgatccttgctctcctatcctctacatcactgactttggttgatctgatgtcaatcattgactagcagtggattccccttcacattaatgacagtaaccttaagagggatctttagcagggattacttaatgaacaatgaagggtatgtttatggcatagcagtattggtgtttgtagatcacagaaactggatgcgttttcaaaatattacaactgtgttgtaatattatatataaattatatataatatattacatataatatatattaaatattatacaatattaaatataatattaaatatacaatatttaatatattatctataatatgtatgtaatatataatatatattaaattatatctaatatataatatatattaaatatataatatataatatatattaaatatattatatataatatgtaaaagattaagataatctttgttcttttcttcttttgatttttaatgctgaacctttgctatatcactctttattttctgtggagaggaggtcccatgtgctgtgtttgctcatgtactagttctaggatttctgcatgggtaattaaatatttactaatatctacctggtacaaaaggtggacaactgtcatcatagggagcttttgatttgcttcttgtcttgggtgtggtggttttagccatcatataattggacaggacaattggcaattacttgaaatacagaatacagattcttttttttttttttttttgagacagagtctcgctctgtcacccaggctggagtgcagtggcatgatcttggctcactgcaagctccgcctcccgggttcacgccattctcctacctcagcctccccagcagctgggactacaggcgcacgccaccacgcctggctaatttttttgtatttttagtagagacggggtttcaccgtgttagccaggatggtttcgatctcctgacctcctgatccacctgcctcggcctcctaaagtgctgggattacaggtgggagccaccctgcctggctcagaatacagattcttttggtaaccttagatgatagtaggtgcttatgtaggggaacaagccccctgcactgaagtatgggttttagctaacctagttatagcagattccacatagattgctgaagagtaaatgccttctggtattctgattttggttggtggtaaattggaaatgatgctttgccttgctaatggccaaattactagtagcttgcattattttatcttgtgtctatttgttttaattggtgcctggaagaatctctaaagccctacactgatttcctctaatgattgaattcgttaccttgctgagtttcattgtgtctgagtcctaatttctgatccaggaactcacctgtcttttactttggaatactctacctattcctaacttctctaagcagctacaggtgtacctgtgcagcagggagatgtatctcctactctgctcttactgtctttttatactgccctctcggacactcagctgagccatacaaacacctgacaagaatttgtcatgtgagaatttagagatctgccaggactgatggtcatgtccttccatgtcagttttcccatttcttatgctcctcacatctcattcctccatgcattgtctccattttaaaacaaaacaaaaatagcatcagttagaattgatagccattttgtaagtttatttgattatgttgctgttttcaagtgtgtctgtggcaccactgctttctaaagtcattttctggactcctcagttcttgattccttacatgtttgctgatgactcatatcctttttgcctagaatgttcagatcctaggaactgacatctgtcatgtcctccgtagaacttctgtttatgaagtgcatatatgacttgtcatccgatccttttttactcttgagtcttttgagtatataatgacctattattttccctttctccctgcaggaatgggatcaggtaacccagagtgcctcttcacatacattgttcaagagcttaacttggtaggaaggaaaactgggttatttgggagaatcagtagttgtcacatcaggacaccggcagtcacagaatgggtcatttcaaggcaggccctggtgctttgggataaggtgtgtgctgacctctctagtaactgagatatctttgagcaccctaacatggagatgtaagggttaactctgaatcagggtgactggcaaggaccactatcagaatcagccaggtatttattgagcatctaggcacaatgctacttggtgacctgcttcttaggaactacaacgtgagcctttattttgcctcgtctgcaactccatccttagcctttgcgttgtcagcctgccttcctttgccacacttgagtcttcctaaccttaccccttaatagcaatcacttcatcatcatgcgctttcccactatcccttctccctgtctcttcccacccatgaaaacaaatttagaaaatgaagggaaataaacaaacaaacaaaaagtcaccattatgatgggattgaggcataatatctgagtaagaagggaataaattagttttccttgacagtatatactgcctgtttctgtccatcctcttatttgcttctttttctttgctcttccactccagtccttaagcgagtttagttttattcgttcctcttgtcccttttcatgataacaatgtgtcatagtctgctttaaagtttttcatacttaccgatgttagttttattgctagtcattcatccctgatgagcaccaacaaattgtatgtgagagatggatttggtagggtttggatatgaggctggagaattgtgtcactgtgaagagagagctcccctggagatctcagtgtaaagttggaggacacctagaacagcaccacatttacattgttcttcagtatcagtaaaagagttatttatactttaaattcaagttgttaaaaatggaggcattccacatgaggctaaatattattcaagattttggtccatcgatgttataagctgtcaacatttaaatctaccaatgacttccaggtgccatgttgcacaaaaagaaggaaagcagcctttcaacaacttggaatttgggacatttctatatgattgggactgttcaccaagtggatgttgctgtgttttgtgacgagatggagtagaggacaaggggatcatttgtaactgaacatttttagcttgtcctatgggacttgttaactttctattaccgcggcctaatccatacagaactcccaacaactaaatttgtggctgatccaaccaatggcatgagttggactgacagttttagaaaaaatacgctttttggaatttttttttaattggacaagaaccatgcataatattaatagtcttaaagccagagaactgggaatgtaatctttttttcctgtgtctctaagtgactctcaattggagtgatgttggcatttctgacctgtatctacctgctgtttttattggcatttacctgctttattgggcttatatgcaatcttgaatacagatttggacaccaattaaaaaaaattaacttcaagtttataaatttctttactatagaaaactacttatatatgtagagtagtaatttttgttttgattttcaatgttttctttatgttatattccaaataaagtaaaacttgaaataatctgaaaatactttttattattgggaaagagatgtggattctttttcaagaaacacaatttaattttcctggaagcgtgtaataacttaagctaagttagtaaagtagtgttaagtaaaagagctcagtaaccccataatgaaaaagaatgattttgaaaataatataaaaaacttaatgttcttgagttgattttcttaagtattttatggtttcctgtagttttcattctactatttactgccagggaaaaaaaggtttgctgagctcaagtaaacagccttatctaacttttaaatttatataaataaatgaaattttcctgctattcaaagttttttatcaatggttgttgcttctgaacattatgattatgaggatttcaagtcatataattggcgtcaccttgttacttccatttttctgtgctcttaaggacagctttataaagggaagagaagtttgttcttattgatgttcaatttttaggtagttatgctcctttaatgttagaagatcctggactcacttgattcaaatgtagaagtctttcccatagatattgttttgatggttcattagaaaaactttcttggtagtagctttagtctcttaagtattctctaatttgaattgttgattgtcattatgtattctacttgagttatttattgagttattaaaatcactaatttgaagttactgctattataggcatgtgtttgtagttgatccccttttggggtcctttaggccttttgaaatagtttattaattcctcacatatgataaatgttacagttcaaccctaaaacattagtataattaagagttagcaggtcggtcacagtggctcacgcctgtaatcccagcactttgggaggccgaggcaggcggatcacgaggtcaggagatcgagactatcctggttaacacggtgaaaccccgtctctactaaaaatacaaaaaattagccaggagtggtggcgggcgcctgtagtcccagctactcgggaggctgaggcagaagaatggcatcaacccgggaggaggagcttgcagtgagccgagatcgcgccactgcactccggcctgggcgaaagagcaagactccgtcttaaaaaaaaaagttagctgtatttgttcaattccaaacaattcagatgcaataccagcagctacttttctacctactgccagatacttagacaaaatgttcagagaatgtggggaggtgttgatctcttgaaaagcacaatcaatttcatgttagactagtaggccattcagctgctctgtgttctattttgtactaaagtgacattaaagaatacttacagatgaataggttttcctgccagtgctgatgatctcaaagatagagctgtgctaggaactctctacattctgattagtaacaattctgtcagagattgtctcagtgttaggtatcagtaagatgttggaacttcagttaggcctttagatcatgtagtccatatatcctttctgtagctacggtagggttttcggacacaggctcgctcccaaaagtcagttattgatgataactgttgaggttttgactgtaatatgcttcctagttgaaatataaatatttgtacaaatgtgtatttagcataccacacaaccagttttgtgaaacaaaagataaactagtaaagaggacaccttttaaaaatagtagtttatgtgtgttagtatatatccatttgccaatatattcatactagtaaaaatagaaaaaaatacatttgttaacaccttttaatagtgagaggtagaaatcttccccaaccaaagggttatttgatttttcttctctacttgtctctaatattaaacaactcttcgtctgttttaaatttagatatataggattattaagattcttttataaataattaccttcctaaattagcattttcacagctacacttttagagttattttttaaaaaacaggtataaaggtagaatatttacaaaaattattacatcatgctttgaacaaatacagatcacatctctgggctattttgacttttaaaaatatcctttttgagcaaacatgctgaagttgatttaaaagtaagattattaatccataaactatgaaaataatcaaaatgagaaagaagggaaactttccttaacgttaatagaactagtcttattttgtttccatttttcattcttactttagtgcttgtttatctgagcattgatatttaatataaaagttgtaggtaaatctgtgtctgtaacatagatgccagttactaaattttatttgcttatgaaatactgtaggtagcaagctgtaaattttaagtagcaaaattaaatttgtttggaatatatggaattcctcaaaaatgaaacggagagaacctacttctgttccttaaacaactgcttattctcatgtcacatgaaatacatcttctatatctctttgtgcctctggcttcttttctgtaaaatgggctcaagaatttaattgactgccttcatccctttcaagaacatttgacagatacttcgaagtctttggaagacaaaatgccaccttgtgtattttttgatactaacttgccttgtaagtacacactatgtattgtacacagtggcgtgatgtgacattgtgaacttttttatgagaacagaagttgtttgcatgctttgatgttaaactataattttattattatttttttataatttctgaacatgattctttcctatattgtccctcccaacacctctgtgttctatactgttcctgaataagaggtgggaggaggtggggtacttaatgttttctggcagtctcttagaaatgtgcaaagaaattgttgtacagcttggttaggaatatatccctggtctgcagtatatggaggagcgctttagcaccttaggaatagacaaaaagagccctctgtttcctcagttttaggttttcttccacaggtttatgctgccctacatgctgactcatgggttggagagtcaggtagaactttttgtttttaatgtatagaaagtgcagttaaaggacagagtcccaatctaggattttggagacctggattcttgcctggtgcactgctcctatactagtattcactttatccggttctggactatttcccgtctttatgaatgaggacactgtggtatgagtgtcctcatgagtgaatgagtgaagagggatgttcttgcattgaatgcctagattgcatacaattttgaaacggtgattaaaagtatgtatacagctacctataattattcatatgaaactgttaaaactcattatcattttctttatatttgcatgtgggggttaatttttactgcctaagaactttgttgcataactcccaacattattagtaaatgctcatggttaaattgccctgtctcctttaaaggatttctaagtgctgtttgttaaactttctgtgattaaagtaattcttgtgaagtataaggaaagatgataattttcatatctggtatttgtgaagtttggtaatttttagtctcgtaacggtttttctctaccatgagactaaaaattattggtgtttttgacaaaattattgtgtttttttgacatcttttgtcattcttttccagagaattcggtcaacagtggatgaaaaagaacaaaaacaacttcttatggatttggatgtagtaatgcggagtagtgattgcccatacattgttcagttttatggtgcactcttcagagaggtaggaataaactgggttttagctgactaatgaatatctaattgggacaaatgaagatggcaggattcgattctattcttaaatgccatacattagtaataagttaatatctcagtatcttagtgtttaaccatggtaatttacatattaacttctgactctttttgcggtggtgggtaaggggtgaatcacacgtgtgtttgtgtgtgtgtgtgtgtgtgtgtgtgtgtgtgtattttagtattggtggctgtcatttgtaaatctcatacaaatattttctgttctttaagaacctgaaaaatcagctgacttctaaatatcagcacttttgctatagttttagattttcattgggccttgagcaacgcctcccccccccccccccccccccgccgccaactttatattttaacttttactcatctgtcatcaagtgtatgtctgcatttaatataaacacttatgtgtccctgcccataatcctgaagtatacccatcagacatggaaattaacaattacaatataaattatttttttctaattctcttatccagatttttgtgtagaaactaaagctctaatttcttggtctcataatcatgtttcttcttttggcctctggttattttgtgtcccaacttgggttatcatttctgcctccagctctcaatccacttactcatttccagtcatccagctgcctaaaatgtggaagtgagtttgggctaggggtagaactggagctgtaaatgaattaatacattatgatatcctagaccgccatcaaaaattgtgatacttagttgagtaggacttgaactgaactgctaagcatttcaaatactctctaaaaaaaatacctttctcattttgcaaatgttaggatgaataaccgagttgttataaactggtaagaaaaaccctcctgctctcttctttttgggatgggattatagagtgtatccttggggtttttgttgttattggctttaaaattaatatatatttttgaaacagggctgaatgtagcactgagtagaagtatatgcaatcttataattggaaacaatgttagaggttagttaattctaaacctaattctgaagtttttgtttgtttttctgggctcttactaggtaactagtaacaacacattctgcttcatgacagagcccatttctttgttgaatcactaattgttaattctcaactcgtagtttttttctattcctgtctttaaataatgagaatattcatttttatgaccagatatactgaatttattaattttcttccatcatttcacatcagcattccgttacatcagtatacagtcatgtattcatgtgcatgactgtatcttggacctaaatattatgtaatgttattctaaatgtttggaactttcttcatgttgcacaagaatcttaccatatcttcctccctttattcccaactatgaacttttcttcacgatcattaaatcatcacaccatatgcagaacaatagttaattagttaattagggactgaactagattttctctcctaactagattctgtggtcaactttttcagtgctgtattcgttttcattatagactttccccagctctgcctgaaccctaaatcacctccatagtgctggaatataccaatttatttcatttgttcatttatttaatcattcatgtaccatttacacacctagccttgggctagatagtgtgggaatctgattgtatgaaaagaaagcagagtaagtcatattcatgattgacaaagatgtggaaacaaagcacggaagcttggagtggtgtctgaacaatattcccatggttttgttatcatggatagctgagtcacatttggttttatgtctcagaaaggttgaagggagttgacatatgcagctgtaaacactaacgtctgttgaatgctttgttgttttcacatatgttttcttcccagtaatcttcgggatttggtggtattatctatcccctttttccagataggaaaatgaaatttagtgtgtttgacaaaagttacacagccaacaagtagcagagatgggattccagagacagaaatcttgctgttccttctattttattagaagtggtccagatatgaagatatatatatgctttttaaataagatttttgacaggataagatgtgtgataaggtgaaggcttaggaactacacagttaagctgtacaaagacacaaaatacctaagtagatgaaacatgaactttcctcccaaatcagaatgcagtctgtaataggtactttctgaataataagagttttagaaaagcagaaagtaacaacttttacaatagtatgttttacaataaaaatatagtttttcaatagttttacaataaaagtgtagttttacaataaaagtgttacttttattagtcacctttaaagagtgaatagtaaaagtgtatttcccgaagttacaaaggttaaaaatattaaaatggccgggcacggtggctcaagcctgtaatcccagcacttcaggaggccgaggtgggcggatcacgaggtcaggagcccgagaccagcctggccaatatggtgacactgcatctttattaaaaatacaaaaattagccaggcgtggtggcacatgcctgtagtcccggctacttgggaggctgaggcagaagaatcgcttgaatccaggaggcggaggttgcagtgagccaagatcatgccgctgcagtccagcctgggcaacagagcgagactccatctcaaaaaaaaaaaaaaagtatgtgtgtatgtatatatatatatattttcatatatatgtaagtaataaacagattgaataagactttaaagaaacatttttgttttgcagttgatgacttaaacatgcatcttttttggtgacatgaccttcagttccaataatagacacaaaatctgagttcatgaaaggaaatagtagaaatgaatgtatgtagtcaggactttttagcttaccttactatcactgtgagagagacagtgctttcaattcctgttactgtgagacaccctccagggatttcatttcacctaatttatacaaccactagactcagctcttggtttggttcagtcagccatccatcaaggagcttatgagatgttccttttctcattcttgcagcaactatttatttatttaaatttaaatgttatttaaatttaaggggtacaagtgcagtttttttatatgaatatattgagtagtggtacagtttgtgtttttagtgtatccatcacccaaacaatgtaaattgtacccatcaagtaatttttcatcatccaccccgttcaactcctccctcccttctgtgtctccaaggtctccagttccgtattctgtccatgtgtgcacatgatttagctcccccttataagcgagaacatgcagtatttgtctttctgtttctggtttgtttcactaaagataatggcctccagtgtatccgtgttgctacaaaaaaaaaaaaacatgatttcattctttttttaatggctgtcactgtctattgtgtatatatgtcacatttttaaaaatgtggacatttaggttgattctgtgactttgctattatacatagtgctgccataagcataccagtgcagatacctttttgatataatgatttatttttctttgggtagatacccagtagtaggattgctggatcaaatggtagttccactaattagagattaatcttgctgttgggtaatattgagcttctgaaagttccgtcacttattcaaagcagtgaataatccttaatactgaagttggtaacttctatgttgccactatcttcaaccatgcatacttctttctaggatggaaccaacctcaaaaagaaaagtccaaagtacagcttggatttggtttagataagttattaggtcactcagttgcacaggttcctaaaagtcattttcaggctttgtaggtaggtggaaaaaagagcttgataataattgaataatggaagtaacttttagcctatattttacaaaaaagacctaccatttatcttaacagtgctgaaacctagtatcacttaaaaatttttctaatacataaaatttgagaatttcatagcaggtaaactcttattttaaacatcttttgaggttgggcaataaattctagtgcagaaagcactgttctgagtaacttgtgaatgtagaagttcatcagattatagaaggcagtgatgctggctgaagcaagttacctcccccttttttatccttacttccacccctcttctcctttccctcttctttctccttgcaagttttaaatgcagcttatggaggtaaaattgacatctgataaacttcccacatgtaaagtgtacagtttgatatgtttgaacaaatgtatacacctgtagaattatcaccaaaatcaaggtaatgaatatgcccatcacttacgagtttccttacaccacgtaggtaatacctgccacctctctgctgtccccattctcagataaccactgacctgctttatgccattatagattaatttgtatttttctagattttatgtaaacggaatcttacagtatgtacttctctttttcagtttgtcgtctttcattcagtataattatcttgcatttatcagtcatttatttctttgtattgccaagtactatctgtaatgttccattatgcagatctatcagtttgttactcatttacctgttgatggccatttggattgttttcagtttttgtctgttactaataaagttgctttgagcatttatgtacaattgtttgtacataagcttttattttcctggggtaattacatgggggtggaatggctggatcatatggtaggtgtatgtttaactttttaaaaaatggacaaacttttttctaaggtagttgtaccattttatactttcaccagtagtttttgagagttcagcttcttccatgtctattccagcacttagtgtgatgtgttgtgttaatctttagccgttctagtaaatgtgtggtggaatctctgtatttttaatttgcatgtttctaatgactaacagtgttgaatgtcttttcatgtgcttatttaccaaccgtatatctttgatgaagttcctgttaaaatctgttgtacatttttatttaaattgggtttttttgttattcggttttgggaggtttttaaaaatgtgttttgaatacaagtttattatcagacctatgatttgcagatactgtctcctgtctgcgcttatctttatatatatctattcttcacagtgtttttggagagcaaaagtttttaatgttgatataggccaatttttaaatttgtgtattgtgcttttgatgttgtgtataagagctcttgtctaactcaagctcacttaagattatctcttatgtattctcctagcagttttatagttttaggtatcacatttatacttatccatttggagttagtttttatatatatcgagagttatatattgatgatttttttttgcatgtggatatcctttgcacctttatcagatatcagttgtccatacagatgtgtgtctatttctggagtatctgctctgttccattgatctgttgtttttctgtctttgcactgatctcacatggtcttggactactccagctttatagaaagtcttcagatttgagagtgttggtccttaaactttgttcttttaaaagttgtttcggctctttcatatcctttctattttcatgtggattttagaatccacttgtcgatttctaccaaaaaacccgaaaaaaaccaacaacaaaaaaacaacctgctgaaatttttattgggatttttctaatttgtaggtctactgggggagcattgatatcttaacagtattaagtctgttgacccttttttgtggcatctcactttattattttacatcttctttaatttttctcagcaatattttatagttttcgctgtataagtctttcatgcttttgctagagttgcccttaagtgtataatatttttaatgctaatacgtatttttaaatttaattttctcatgtgactaaatgcacaaatatcatttgatttttttatattgatcttgtgtgcagcaaccttgctaaactcaaattccagtagctttttttacctgccttcagatttactacatagatcatcattttgtctgtgaataaagagagttactcctttctttcccaattagttcctttatttatttttgtcttgccttattgcactggctggaaccttcagtatgctgttgagtagatacagtgagagtagacatccttgttttttttcctgatcctagagggaaagcattcatgtttccttcattaaatatgatattagctgtggacttttcatatatatatatttttaatcaggttaaggaagtttctttttactcctagtttgctgagagattttgtcaggaatggatgttagatttttgtcaaattctttttccagatccttgagatgtttttgagatgtatggtttgtttgttgttttaataatggtgagttatatgaattgatctcagatattaaacatagcttttatttctgggagaaatccagttggttaggatgttttatcttttttatctatcattggattcaatttgttaaattactaaaatttagctaatttgctaaaattcatttaaaatttttgtatctatgagagacattgatgtatagttttcttttcttatttttgtctgacttgcatcattgtaatgctagcctcataggatgagttgggaagtatttcttcttcctgaattttctggaagaatttatatagaattggtattattttttctgtaagtatttgatggaatttaccaatgaagccacttgaacttggcaatttctttgtgagaatatttttgactgaatatccagcttctttcaaagatatagttctattcaagttacgtatttcttgtcgagtgatctttggtatttgtttctttgaagaaatttatccctttcatctaaattatcaaatttattggaataaaattattcataatatttcttttttattattttaatattggtagagtctgtagtgtgttacttctgtcttccctgtctccccctccctcccacttgtttctgatactggtaatttatgtcttctttttttcttcccaattagtccagctagaggtttatcaatgttattgatgatctcgatgaaccagctagctctcagttaaatgattttcttttcttttcttatctttaaaaaaaaaaaaaaaaaaaagtcagggtcttgctctgtggcccaggctggagtgcagtggcatcatcctagctcaacccaaccttgaactcctgggctcaagggatcttcccacatcagtctcctgagtagctgggactacaggcatgcactaccaccaccctgctaattgaatttttttttttttttttggaggtggggtctcactttgttgaccaggctagtctcaaactcctggcctcaagccatcctcccaccttggccccctaaagcattggaattacaggtgtgagccatggcgtctggcctccgttacatgattttctgtattgcttttctattattattttttttgacggggagcggtgttcgttctgattgtggtttcttccttttacttatttttgcttaatttgctttttttgtttgtttcttaaggtggtccatgttccttttaaactgtgaaattttttaaacatagactaaattacagaggagaaacagctacccaaatcctatattggcatatttactctttatatgtcttcaaatattataaatagaattaaagccctcatcacatttccctttccagatctcatcactaccctgagtgtttcctttaacttgtttgtttaggtcatccatatgtgcattttcccctacattttacataatatcgctttatgtattttcacatttaagtaaatggaatcctatatgcgttctttattgtacattttattcaacatagttttattcaacatagttttcaagatttatgtaaatatagattcgtaatatacagatttagttaatttattttaactgtagtattctaatgattaaatacacctttttattttatttttttagaaataatcataatgtagattgcttctcatttttttataattataaacagcacaaaaatgaagaattgttttgcatgtctctttgacaacttaggttacagattatttagcatatgtccctggaaatacagttactaaatttaatgatacaaatgtctccaactggagtaccgacttaaatttccaccaaaatttctatatcaataattgtatttggtatcagccattcctgactgttagtagcttgcttactttatagtttcagttgttaaggttacctcatgatccacattggctcctagagttcagctatcatgtccacacgaaggaaaagaaaagggaagaactaaaaggattttcctggagtcacaaaccagtggttttgtgttgatacctctttggctgcctttctatactttaaagactgggaaatgtagattttagccacatacattgtacagaggaaagggggaatggttatttagtatgccatcagcatttactgtcacagatctccttttacctggtgtgtactaacatttgataataaacgtttaatttttggcagtttgaaatggtatctcacttttaaaattgcatttccttgattggtgagatacagaattttttacatgtatttaggctttttttaaaaaaaaattgcctttgatataattctactgagtttggtctttccctaattagtttagcataactctttattattcaggatactgatcttttgtttctttacatccaaatagatgtttttgtctcttatttttaaacttttggtatgttgtccttgtttatacacaagtgttcattattatggggttaaatttaacaggtcttatcctttgtgatttgttgtttttatgtgtgttcttgggaaaaatttttttcctatataaaagtcatggagaactcttagaaaaaaagttttaaacttttgctttttgcaaaatccatttgggagtttttgtatatatatttgtgaatgatttaatgtcagaatttaatgtttttctatatggaaggccagttgtcccagcagcattcattgaataatgcattcttttgctatgatctgctttgttaacttctgtcatatatcagatttctgtctgtgcatgaacttttgcatctgtttctttggtgtatttatcttttatttgtgattgcttcataaaaagtctttgtgtagtaggtcagtatctcttctttaaaattatcttagttattcttggctctactttaatataagctttagggtcagcttgttcaggtccttgaaaattttgattagaatttaactgaattcttagattaatttgggagaatttgacgtgcttctcatcttgaatcttcacatttgtaatcatggtctgctactccatttgttcaggttattgttatgtcctttagtaacattttatatttgttttcataaaggttctgcctattttattagatacatttcctggtgacttagtttatatttttattgagaatgatatctttttattttcgaattagttattggtatatgttattggttatatacggatctttaggaacccttccttatgttaccttagtagttgagttgttcatcattctccagctttttttcccccaataaacccacatttattcacttcttctgcatttcagacctgtggtcatcctgttttctgcttgagcatgacagtcatgctgctgtcactacctttttcaggcagctcagagcatttcattttttaaatgcagctcattgccattgtgttgtttgtatgaccaaaaggaactgtcagagagataagaaggttacattaggttatgttccttaaaaatcacaaagacctctctatctcattgctcttttctgtccccccttctcatcttcagttctcggtttacttgttacctttattctcccactcccatgtccatctttctcttttatttgcccacatttcccttccttctcccttccatttggtaactatagtttttagcacctgccaggcactttagtttgtgctttgcatatgttaactcatttgccctttatcacagtccactgaggatggtggggcagtctcatttcatagctgaggatgcgaggaggcccaagcttatataagtagaaagtaggagagcttggataatgtcaggcttttcagactcctaatgtcatttttttttccgctttgctatattattgaggttgtttctttctactgtttttataagtggatgaagtaaatgtgctgtatgtctctaataagattttttagtaaacctatttagatagtgtctctaaaataaagctgtgtctgttttgggtggagggtgttactcgatctttcatgatagccattctcatagatcactctaaagaaaaagagatttacagagagaagaaagatttaaatgcagaaataataagtaaaatttactacgtcaaatatgctttacaaaaacattatgtatagccatgtatctgtgaatgttctagaaagtggtccttttgtaagagtgcatggcaaacgttgatagaagaaacacattagggacagtggattctattcatgggtagtgtattgttctgggcaagtaattttacttttaacaggcattaatctcctatataatccaaggataggattgattatataattattatataatcgaaggataggagattaatgggtagaaaatctttgatgatacagctgtatttataaataagtaacaacatacagaactgtataattttttaaaaatcattttgatagtattttcatttttgtaaggtactttgtagttcttgttcatctgtgtatcctgtacttttacagttataatcatggtatctacttttattttttattttttcatgactcatgcatctctctcatgaactgtattcattttcaaaaaaattgattttagataatctctttaatgttgttgtattcccttttgtgagatagttcctcggtttctagttttgttttgttttttctttttgtaatttatggaacatttaagttacattcccagtcataggatgattctataaaatggtatcaacacatttatttctgttttattgtcaaattgctttcaaattggtttaaaacaatctataatgcaagaaatgtttgaatgattcagtttaattatagccagcatccagtcatttaacaagtatttattgagtctttgttctggcagaggttacattctagtagggaatatatgagacaaacataataaataagtaaattacactttatattagaggatgatgaaggctttacagaacagagcaggataagggagtgcctgatgggatgacttgcgctttgcatcagttaaagtaggcctcactgagaaggtggcatttgtacggggtcttgaggcatgggatttactttatgtatttttgtctttttcctttttttttttttttttttggctaatttaagaagtttatgtagtctcttaagattactgtcatctattttcattgttagtaagaatggttttctacacatttcctatttttttttctattttggcaaaatttgaaattttaatgaaagcacagaagttttctgtgtaagcctgtccctgtccatacaattaaagagtggggaaaattggctttaactacattgtttatgtttaaacctgagtagaatattctgttgaaggctttaacaagaaaacaaaaattattactagtttgacatttgaaataagcaagaataagattgctcctttctattgtatttccattttaagtaaaggcaaggtgatatttaagatgtataagaataacagatatttgttattttatagggtgactgttggatctgtatggaactcatgtctacctcgtttgataagttttacaaatatgtatatagtgtattagatgatgttattccagaagaaattttaggcaaaatcactttagcagtaagtacctggtctttaaattattcattgtgtatatagttatatagagatgctgctggagttttgaatgcacatatttgagtgtcactcacagtaccttcctgaaaataattcatagttaataaccagagacaaagtcacttctgtggggtagttaacacaataggtcataatggtctcgataaatactgccaatgttctttccctttgaatctcaatgagtcataacagactgttctgtaaataaagctaggaaaagcaattttctgttcattttttcctgttgctttaactatttttaaataggttatattaccacagttatcctgaaattaatcagaatcacagcagtctccttgaagccccataattgaagcccttggacaaagtttgtttactgtgatttaagattttggttactccataattgaagcccttggacaaagtatgtttactgtgatttaagattttggttattcagtctaaactatttaaaattttgactagcagtttcaggggccagtgttactactaaatttggttaactcacttttaccagagtaccaaaaaagaaaatagctacttttttacatatgtgtttatagttttgaaagtgaattgatcactttgtttcttgctctgaatcttaattttttttcctaaaggaaaaagataatttactttttatagagcaaaattcataagattcttagaaactcctgagaatctgagctaatggcatgttctaggttagttgatatataaactaaatcatacaggaaattgtaaaatagatactttggttgcatgtaatttcctagctcttccttacctgcatactccccctccaatgtagttcaccaagatatatactctttcaaataatttcataaaaagattttatgaaatcattttatttttaaattttataaaaataattgtataaaaagaagctaacttagactagaaacttattatttagcggggtatatgaaattttacaatgattagtttagccatctctctctaatatattaaacccgtgttatcttgaaacttactatttgtaataattataataatagaaaaatgataatagctaatggttattaaatgcttatttgcatcaaactatttgtgacattaaatcttcatagtaactctctgtggtaaatagtgttacctcatttttatgaatgataaatctgaagcatagacagattaaataattaatatgctttgaagtgtgtaagtggtaaataatctaaatccaggcagcctgatcccagaaccctgctcttaaccgctgtataacagggtgaccatgaaattagaaaacagaaaattattttatcatatattgcaatataaagaatatatactgtaaaaaatgatttattccatatttgcctaagtcaagacttggtgatcactttatatatattaagcacacatgtaaaatactttgtatttagtctcttcttgctaattaataaaccagcaaacaagcatagctattcacaacaaatttatgtgttctacatttcttgtacctagcagcttgacgtcagcaaagacgtcaccttacagcaaatagttggcctgttgtttagttctcttttagtttgaggttgtgtctcttttccttcccttcctgaagaaatgtgtaattttctgatcatgatcagtgaccaggcaacaggataaattcccacagtggtgaacagagtttacactagctcttcaaacatcaccttgaaggcttagcatccaatgagggtggatgatgatgaggaactgagagtttagaaaacttttttatttactactggacttagaaattgaaatcgattttgctgcaagttattactcttagttgaaatggaaccaactcagtgatcattgttgtcctgtttttatttttgaacattttagaggccaggcacaatggttcatgcctgtaatcccagcagtttgagaggccgaggcagaaggatcgcttgagcccaggaatttgagatcagcttgggcaacatagtgagaaccctgtccatactaaagatgtaaaaagttagccaggcatgcatctgtagtcccagctacttggcaggctgtggtgggagcgagacccagtctcaaaataaaaagggaaaaaaaaaaaggaaattttaggttggagataggaaaaaagataaaattttaaatgaattattaaacaaattataagtctaagttactgggttttttgtttgtttgagctatcagggaacagcatataaaggcaactaagcttttagatctaaaattattcagtatctttggttaacaagaaatgacaaaatattgaaatattaagcttaaaatgtatgcagaggactacacgggatattacttgtgataaactgttgtgctgtttgaataaaaagaaacaagttgtttatcccatctctcctttttctccctagactgtgaaagcactaaaccacttaaaagaaaacttgaaaattattcacagaggtgggtatggattggtattttttgtaatagaaattaacttttttctcctaattggtgaaacggttattgaaaattacagtgtcactgtataaactttcctaaaatatttgtatttttagcaaaaaatgctttatgtactttaaaactctattactgctatttttttctttgggattcaataaatttcagtctatcttagtatgttggacttagaaactgaaatagattttgctgcacattgttattagttgaaaaataattattcatttgcctgatagataatgtttttctgcatacaaataaggcatcgaggtggtcctgtggacattcaaagaagaatctgagggatagtaccctcaagcattttaaaggcatgctatccctgtctgttgtttcttcttcacattagaggatgtttctaaattgagagaaatcttttaattagtattataagttgaaatttctctaaagcatgttgtatttgtgtaaacagtgatcttgcctttattagatacatattcaaatgaagcatttgatgtagttgaaggccagacctagaaaagtagtaaccctgtgggaatcctgaatttaatctggcaaatagatgaagtgcttgctttacttattactgtgctagactcagggtaatgaggtgctggctttgaggaaacacaccgaatcactacccctcagcaaatttgtaacggaaaaacctgacagtaagtggcagtgtgtgatttagcctgacagtaaataggaaggaaagtaaagggtcaaaatgaagagaagtgaaaaatttctaattctgggagacaatttctagtggttaaagaaattagtaattgggccatttatttaagttcttttgtttgtggttgacactaggccactgaaattagtgaaccttgaacatcagtaaattttatttaattttgtttggcttaatgcttgttagaaataatatctttttttcttttggcctaaaattatgtagagttaggtccctaaacaaaattctttgtttctcttgtatttcttcttgttcttgtcttgatttttttttttttcccttctttgttagctgtgttctataattatgagagtagcacctttgaggcatttgatagttaccttagggatatttactgatcacagtaaagcaccaaggtactgcctggggagtagttgaataaaataaaaaaacttcagaagtaacttttattgttctcttactaaatgaagtgatgagtttatagccatcttttatcagttaggatcagttagcttttttgttggagtcagtgcttttgattacaagtaatagaaaatcctgataactctctttaaacttcagggaaattcattatctgtcataattagtccaaagatggggtggctcaaagcacaatatgctcctcttccttctgtcctccttcatgtgttaactctgtcctcagggtagtaacaactagagcagttcccactatcatgtctatatgtggctgcctcgtgaagaagaggtgctctcgtgctgtgcagctctgtagggagtatggaaacttttcccacgtctctaataccttttcttggctcattcaccagaagtgcctcatgcccttaaaccagctactatcaagaagcatgagactacccttataaaacttataccagccaacagccaggttttcgaggtgtggatgttgatgagaagagatacttcaataaaacacaggttctgttagaaagtatggatggggctgggtgtggtggctgacacctgtaatcccagcactttggagaccaaggcagctggatcacttgaggtcagaagttcgagaccagcctagccaacatggtgaaaccccatctctactaaaaatacaaaaattagccaggtgtggtggcgcatgcctgtaatcccagctacttgggaggctgaagcagaagaatcgattgaacttgggaggcggaggttgcagtgagtggggattgcaccactgcattccagcctgggtaaaaaagagcgagactcttgtctcaaaaaaaaaaaaaaaaaaaagcatggatggttaggaatggatgtttgataggcccacagctgtttcggtcatggtaagagatctttactgaatttttttgtggatcaccttctgagttacatttagatgttttctgcatcctatattttaaaaccttattttttattcattgagccaggatagtgacaaggacatggataaaaggactgagctatggatagagaattagttggcacatactggtagtgacttgattgtcaatgagaaagggatttgacattccttatattttgactgttatgtaatgaatctggactaagtaaatgaatttgtaagcctcttgaaaacaatttaatgcctaaatttcttgtgaaaattttttttgatattcagtttttaagcactggcattcagaaaattgttttcctttctcattttcaatagaagaaaaccattgttttttctgtgttttataaatatgaagatgttaagagaaaaatcaatccccatctatatcttacagattaatgtttgtgaaatgacttttgctgttacatttacacaattatagttattaaagctacatgtttaaaacatgaataattattgtatgtgataaatgaagatgttttacttcttatatatctgaatttaaggacttgaccacttatgttgtctaaggtttttcaatatttttgcttaaagtgaagccttatgtaacttaggaagaagctaattgtatactgaatgatatctatgtcttgcagatatcaaaccttccaatattcttctggacagaagtggaaatattaagctctgtgacttcggcatcagtggacagcttgtggactctattgccaagacaagagatgctggctgtaggccatacatggcagtaagtgttaagtccaggccttcttgcttgatagtcattgcacagagagcctgtgctcttttgtgctggccattagtcatacggttttaccatgaaactgctagaatatttcccttaccctaaggcccaagctcaggtcctagcctctccatgaaactttgctaaattatcccagtcagctcctgttttcattgtcttgctttatttctcttacttggtatttagcagttgtggtcttctctgattattgttttttcattatattgaactcaactcattaaacagatggtaacttctcagaaagttcccaccgtcccttagtgagacaaatgggaagccttgagttcattagcagaattcactatgtattacagagtctgaagctgcatattttgaatattgttagtccttttttttaggggtagatgaagcacaccaacaaatgcaaaggtagaggccttcagtattttgcaacctggagcctcttttcctgcaaagagacagatgtacactatccatccatagatatcaaactcatcttaccccagtatatttgcatacagtgttcctacagcctggattttgatctgtatttgaatgaaaatgtagtgtctgtatttcagacatttccctaggtgttaatgtctttcttcaatgttgccatggttctttggggaccagcacactactaaatgtgacacataaggttttgtggttgtttcttgaggcctccctgccagcagcatttctttccatctttgtagactgttttaaactaaagataagcttagaattgaataaaattgttctttcttggtttcctccttgatatatatgttttcaaacctagtgctataaataataaaaaagtaagagtcacaggctagatattataggtgttctagattatttatgaatggataggcttagtgctactacaaattcaacttactgcatttttcaatcctcttttggttttgttatatcttcccatatcactttttcttcagatgaacatgtaaaagcggtgtgtgtgtgtgtgtgtgtgtgtgtgtgtagacacctaacctgtgtggtaagaccttttaaacttttggttttgtggatgttgactggctgggcagatttcttgactcagtttggaagatcatttgtttatcgtgataactagggataaatggcacaatagtttcaaaggcaagaaataaaaaaaattagacatggagtatttgggaaatgtgatttacatatttattaaggataccccgagaatgaactgaaattgttatttacagttttagggcttgtctcgatactaacagtgactaaatgtttttgttgtgtgacactgactaagaattatatttgattgaagcaggctttgaaaatgcaattgcagcccagataaagtagaatattttgaattcagctttctaagaaagactcagactttctttaaaacagactttcgtcattcttgtgcagagatatgctttgcaggcccaggagatgtaagacttctgttttcttgctgaccttcatctgtggaacacaaaggctgataaactcttggcctctaatctttactggaccagatgaaattcttctgtccattctcatctttcaaagcctgttatagatagacaagaactcaatcaatgttaattttaaaaggcttcaagtggtttgacttttcttcaaatattgacaaaacctattggaggtatatcattttatttgagatttatagttgtctttagtctacaggacttaggattactcattagattgtgcaacataaaaaagtaaataaaatgtagagtttacacataaattttcctgtaaaccgatttcttgtaaacattttcccaactccataccctcatgtaggtacacagtcttatgttgcttaaccgtgggaatatgttctgagaagtgtgttgttaggcaattttgttgtgcaaaatcataagtgtacttacacaaacctagatggtatagcctactacacacataggctatatggtacagcctgttgcttctagactacaagcctatacagcatgttactgtactaaatactgtaggtaattatatcacaacagcaactatttgtgtgtctaaatatagaaaaggtacggtcaaaatatggtataaaggaggtagaggtgacgggccggagaaagatggaagactaccaggctgcggaggagactgcttttgttgttgatgaagtgagcaaattgtaaaagaggctatagaaagcacaattggtggttaacgcttattaacacagcaaagtgaaccagtggaacacaaatgtagtagaacaaacttcaagccaactcaccaagctgggaaaaccacttaaatacattgtgacctgtgtaattatgcaaaagaatggagctggattacacatggcaagttcctgcttctgggacagctctgctgacaggagctgcactgtgcgatgggagaataaaaccatgtactgcatcgtcggcacctttggactgtgtattggacctcctagtccagcctgtgaccttcctccggtagttcatcttctaacaccagctatgaattgagtgaactcttttctcgttctttttaagtctgttttgtggcactctaaaaatgcagagaaaaaaaccaaatgaccgcactgttacatgaactgtgcactgaagtcagatgagtatccctgtaggtcgcctgcagcctgcattgccacttgtaactctgaatatttcttttcaaaggtgctaaaatctgaaatctgctggtgtgaaacttgctatactgtctgaaatgattcaaatacactaattttccatactttatacttttgttagaataaattattcaaatctaaaaaaatatggtataaaaaataaagaatggttcactggtataaggcactaatcatgaatggagcttacaggactagaagttgttctggatgagtcagtgagtgagtggtaagtgaatttgcaggcctaggatgctactgtagactttataaacactgtacacttaggctacatgacatttataaaaatttttttcttcagtaataaattaacctgagtgtactgtaacttttttactttatacactttttaattaaaaaaaattttttttacttttttgtattaacacttagcttaaaacacaaacacactgtacagccgtacaaaaatattttctttctttgtatctttattccgtaaggctattctgtttacttgtttattctttttaaacttttttgttaaaaactaagacatcattctaggcctatacatgggcgcgatcaatcactgtcttctacatccacatcttgccccactggaaggtcctcaggggcagtaacacgcagggagctgtcatctcctatgatatcaatgccttctttgtaatacctcctgaaagacctgccagaagctgttgataacttttttttaaataagtagaaggacatcaagtatagtgtactgtacataattgtatgtgctatacttttaaatgactggcagtgcaataggtttgtttaaaacagcatcaccacgagcgcgagtaatgtgtcactctacgttatgagggctatggtgtcattaggagataggaatttttcagctccattataaccttatgggacaacctttgtatatgtggtctgtcgttcaccaaaatgttgttttgcagcacgagacaatttctgtatgtgggtatggatgtgccaaaccacctgaaagttagttgcagatatcatgcattttattctaaacacttcagtgcatatctcccaagaaaaagaccattcttctacataaccacgatatcattaccacacctaaaaaaaacaaacaagaatgtcatctttgagcatccccattccaaaaatgcaaagcccgaaatgctcccaaatatgaaacgttaccaacactagtgtgacccaagtggaaaattcacctgaccttatgcgatgggtcacattcaaaatgcaggtgcaccacatcttgttgattcagtgttcccaaggtaaaaaaaaaaagacccttgtggccccctttagctgcaatatatcttttccacacatgcccagattttccccacataagcatgcctacaaagggtaataaaatggcatgtatgcaggcaagatgtgctaatgacaggttccacactatacctcacatggggccaagacctacctgcattactcactgtatttttttttgttttttttgctcattttttgctcagtagcttaaagttaatgttgaaaatgtcaaagaggcctgcagatacccctagagagacagcagtttgttaaaggggataaaggggaagtgtttatgtttatagcacagaaagtcaagctgttagagaaactggacaatggtgtaaatgtgaaatgtcttacagaaaagtgtggtgttcgtatgagcaccatatatgacctgaagaaacagaaggagaaactgctgaagttctgtgctgaaagtgatgaacaaaagttactgaaaaatagaaaaacaccacataatagctaaaaatgaagatcttggtaatgtattaaaagagtggatctgtcagactcacagtgaacacatgccatttgatggtatgctcatcatgaaatgaacatctatcatgaagaactgaaaattgaagggaactgtgaagattcaacagactggttatagaaatttaagaaaaaacatagcattaactttttaaagatttatggtgataaagcatctgctgatcatgaagcagtggagaaattcattgatgaattcgccagggttattgatgatgaaaattcaacatcagaacaggtataatgctgatgaaacatcactgttttggcatgattaccccagaaagacactacagctgatgagacagcccctgcaagatttaaggatgccaagagcagaaaaactgtgacgggatgtattaatgcagtaggcccgtataggtataaatctataggaggcaaaagcttgcatccttcctgttttcaagaagtgaatgtcttaccagtccattattatactaatcaaaaggcctggatcactcgggataccttttctgattggtttcataaacattttgtaccagtgccttatgcttattgcagggaagctggactgaaagaagagtgaaagattttgttatccattgataactgttctgcttatgctgcaaccgaaattctcataaaaaataatgtttatgccatgtactttcacccaaatgcgacttcattaattcagccatgtgaccaggatatccttagatcagtgaagggtaaatataaaaacactgtcttgaacatcatgctagcagcagtgaacagaggtgtgggtgtggaaggttttcagaaggcgtttagcatgaaggatgtcatacatgctgttgccagcacttggccaacagtgactaagacacagtcatgcctgcttggcataacctctggcctgtgactattcagtgatgatgatgatgatgaacaaggtagtgacttggatggattccatatgttaaagtgagaaaaaaatgatatctgacctccttttatatgcaaaaaatacatctttagagtctgtcagtaaacggaaagaaggggatattaaagaagtttttattatcaaattaatgaagcttcagtttttcatttattgactaatgatgaaatagctgaaatggttctgaatcaaggtaaatgtgatatttagtgataatgaggatgatgttaacaacgaggaagaaatgcccatagacaaagtgcacattctgcatatcaaaagaaactatcaacagagtaaacagataatctgcagaatgggagaaaatatttacaaataactatgtgtctcacaaagttctaatattcagcatctataaggaacttaaatttataagaaagaaaacaacctcattaaaaagtgggtaaggacgtgaacagacacttttcaaaagaagacatgcatgcatccaacaagcatatgaaaaacacaatgtcactgattattggagaaatgcaaatcaaaaccacaatgagatacatctcacaccagtcagaatggctgttaaaaaatgtcaaaacaacagatgctggtgaggttatggagaaaagggaatacttatatactgttggtggaaatgtaaattaattcaaccattgtggaaagcagtgtggtgattcctcaaaaagctaaaaacagaattgtcattcaacccagcagttccattactggaaatgggtatataccaaaaggaatagaagtcattctgtcataaagacacatacacacatatgttcattgcagcactattcacaatagcaaagacatgtaatcaacctaaatgtccatcagtggaagactggataaagaaaatgtggtacatatacactgtggaatactctacagccataaaaaagaatgagagcatgtcctttgtgggaacatggatggagctgtaggccatccattaatatctaaggatacttacttagcaaactaatgcaggaacagaaaatcaaataccacatgttctcttaagtgggagctaaatgatgagaacacatggacacaaagagcaacaaaacagacactggggcctacttgagtgtgggaggtgggagaggatcagaaaaaataactattgggtactaggcttagtaactgggtgaccaaatggtctgtacaacagacctctgtggcatgagtttacctatataacaaacctgcatgtgtaatcctgggcctaaagtaaaagtttaaaaaaaataaaaattaggccgggcgcggtggcacatgcctgtaatcccagcactttgggaggccaaggtaggcggatcacttgaagccaggaattcaagaccagcctggccaacatgtgaaaccccatcactactaaaaatacaaaaattagccaggcacagtggcacatgcctgtaatcccagctagtcaggaggctgaggcatgagaattgcttgaacccaggaggcagaagttgcagtgagctgaggttgtgccactacacttcagcctgggcaacagagcaagattctgtctcaaaaaacatatatataaataaaaaggaaaaaaactaaaaaaagttttaaagaaaatggaaacaagctccctcattcccccccccataaaaaagaaaaaatgctcttgatgaaaatgtgtaatggactcattaaaggattagagcagtatgcattcataacacaagaagaaatcatgtcagtttataaaactgaagagagactcctaagacaaaaaccattgttaatgaggcagttgactagggaggaaacattttacaaagccatctagcagaatgcctcctcattactagaggacccacttctggcccctcaaatgcttctgatgtttcttctcacctaaaaaaataaaatacagtgtacaatagccttttaatcaaaacacagcatcgtagttggaggttgaaagcttgtagctgtttgttgtagctgctgtttaacagttgatgcaggtattctggcgatgctactgtgctgcttagttccccagaactcattgtttttcactgtattgatacgtcatattttttactgttaagtatttgtgtgaacaagtgtaagacaatgattgcctattaatagcatgtaaattccgagtccggaatgatggtgatgcccagcaaccacagattgtctacctgggtggctgagatagtgacacttttgctttttggtgcttcagtgtacacaaactttgtttcatgcacaaatttatttaaaatataatataaaattaccttcaggctatgtatatagttgtatatgaaacataaataaatttcacgtttagacttgggtcccatccccaagatatattattatgtatatgcaaatattccaaaatttgaaaaaatccaaaatcgaaacactcaggttccaagctttttggatgaggaatactcaatctgtattatctaatacatagttcatactcagatttcccatatgtcaaaaaaactatcttttagctgtcaatccagggtcacattaagattccataccagctactcaggaggctgaggcaggagaatggcgggaacccgggaggcggagcttgcagtgagccgagatcgcgccactgcactccagcctgggtgacagagcgagactccgtctcaaaaaaaaaaaaaaaaaaaagattccacattgattttaattgttacattattttaatatatacagggcttgatcattctttttgttttctgtgacattggcggttttggaagtgttttcagaaggtctcgcattcttataatatctgattgttccctcatgattagattcagactacaactatttttagacatgcatacttcatgtatgaggagtgttttttattgcataacattgcaaagcacataatggttactatttgtaatgtttacagacatgccttttttttaagcagttaaaacagttgcagaatagaaagtggtatgtttctttattcatttaggtcttcttgccatctctcagcaatgttttgtagttttcagtgtgcagcttttgaagaccttttaaatttatttctaaggagttcatggtttttcgatactgtgaaaggaaaataaaaacttgggaccccaatttactatgccaaaacaaaaaattcagctgaaagctgagtgatgtaaataaaaaactgcctttccttttgttcttaagcagatagctacagataaagttttaaatatctccacaggtagctattccgttcaccttatcttatttaagtgctaacttactgaggatgagaggaatacataatcaactattccgtacttgctccttttctcttgcaacatacggattcagtaatgtgaccacaccctccctcgtccccctgctgcctgcttttcctctttaattattgaagccctcaaaatcatatttggagaaaggcacaaacttccctttcaggcatgtccttaaccgtggcaagataaacttctaaattgattgagacctgtctcggatttctttttgtcttagaatactgttattgggagtggaattaaaaatattttccaatattttgctattattatatagaaatacaactgctttgcatgtgttaacattggatcttgtgaccttgctagtttagttttactgttagtttcagtaggaattttctgtgtctgtgaataaaggtaatgcttgttttcccccttgcctttctatactggctgggtcctccagtagaatcctgaatagtaataataatagtaggcatatttgccttatgcccaatattaattaaaaagaaagtgttctatatttcaccagtaagtataatgttaactcttggttattttagatgccctttatggaaatgaagatgttttcttctcttagtgtgttgttatttctgttgttattagtgggttttacattttgtcagatgctaattctacatttattgagatgatcacattattttcttcctttctataaataatggtgcattgcattgattttcaagtattaagttagtattgtattcttgagataaactctacttggtcatgatacattacctctttgtatgttgctggattaggtttgctcatattttgttatttttgtgtctttctgtgcaagggctattaattgtcttgtaatgactttgtcaggttttcaaaaatcgttatgctggcctcatgaaatgagttgggaagcgtaccatctctcacttttttgaaaaaaaaatttgtgtaaggccagtgttatttctcacgtatttgaaaagagttcaccagtgagcccatctgggtgtggacttttctttctgggcaggtttttaataacattcattaagtaacatagtttaaaggttattcacactttgatattctttttggtaggttttcattttcagaaaatatttctgtttcatctatttctgtaagaacagtagtaatggcccctctttcattctgattttagtaatttgtatcttttctttttctgtgggtcagtctagccaaaggtgtgtccattttattgatcttttcaaagtactgttggttttcttgacttttctctattgtttttctattcctgttttacttgtcttcacgttactttttcttacgttcttcctcctgcttgctttgtatttcatttgttcttttttttctaattctttaagctataaagtaggtttgatttgagatgtcttctcttctaatgtatgcattttacactatacattttcttctgagcactacttctatatcccacaaattttgggaagttgtaatttcattttcatttagttcaattttttaactatttcttgagacttttttgatccatttgtcatttagaggtgtgttgttaaatcttcagatatttgaggactttgcagatatcttcctgttactgatttctaatttatttattttgtgatctgagaacatgctttgcatgctttccatcttttaaaacaaggtgtgttttatgccccagaatgtggtcaggattaatcaatgttccatgctagtttggggaaaatgttgatcttgatgatgttggatggagtattttttctcttggttgaatatctgggattttaatgtgtaccttatcaggcaaatacttatatttacaacaaaaaaaaacaaagtaaatagcttacagtgaattttatgcagcacagtactcatgctcaaagcaatatacagatgtctttagttgatgctcacaggcagagaatgtaatacagtcaactattatgcttctctgggcatttctttcaacagcagttactctcagacttagcgaaggatccattgtcaactctgtgccaacaggaccctctctctctcttcccttttcctgacacatcatttagatggtccctaatttcaaggaaatgtaaagatgttctttcacagaaattactaaaaatgatttctgcggtacataggataatatattactgtcttggcagtgctttaatttggctacaaatgactaacagacaaatatctttacacatatgtgtagtgataaatttagcgttattgtgaagtatgggtggaataattgtgataaatttagctcttgttttgcttttgtgtctcaaatatattgtggtatggcctcatccaccgagcaaagtcttttaaaaatcgaagacagtcttttttgtttgtttgtcactcgttgccccaaatttgacctaattctttttttaaaacctttttattttttaattttttttttgagatggagcctcgctctgttgtccaggctggagtgcagtggcatgatctcggctcactgcaagctctgcctcccgggttcacgccattctcctgcctcagcctcctgagtagctgggactacaggcacctgccaccaggcccagctacttttttgtatttttagtagagatggggtttcaccgtgttagccaggatggtctcgatctgctgacctcctgatccacccgcttcggcctcccaaagtgctgggattacgggcgtgcgccactgcacctggcgaccttgtaattctttatgttttccagttttcttcctttgtctccctcttccctcagcttcagctttgtaaatgcttttgagtctttgaggggaatagttaaatgaattgcttagtgttctctttatggaagtagccattaagttttttgttgtttgtttttatgataatgatgacttcctattacttccattctgacgctagacatggattcctctaggaatatactggcattttggctgtctacccagctgttgcttccatttgcctattccttgagtgtaaggcaattaataacttacacttgtctttatgttccagcctgaaagaatagacccaagcgcatcacgacaaggatatgatgtccgctctgatgtctggagtttggggatcacattggtatgtttatgctgattcaaccttgccacagtagcgtaacaataagaaatttagaagtgaaagaaaacttaatcagacttccccgttcgttaagaactataatcacagacactatggttttaagttgctgaaaaaaaaaaagtatgtatttatttactttaaaaatcaaatcagacttgattatttcccttgaagttatgtgaagtgtctagagccctttaatgttttaactggatctcttggccacagataataggagtcaactattatctgcaactgcactaagaatgggaacaggacaagccagcttacctgcagtcaattcattgatgaaggcacataggcttctcccatctcaggcaaggtgtagtatgtccagtaatactgtatatagtgtgtatattaagtatacgtatttttatatgtggaaaatagtttctacttgcaatattctattcactgaatagtaaaatcacaagtgaatgagctgaaagtaattcagtttttgagggacaatatattagtccattctcacactactgtaaagaactacatgagactgggtaatttatgaagagaggtttaattgcctcacagctccacaggtcgtacaggagcaggggagagagagagtgaaggggaaggtgccagacacttttaaacaaccaggtctcatgagaactctatcatgagacagcactagggggatggtgcattagaaaccaccctcatgatccaatcacctcccaccaggccgctccttcaacacatagggattataattcgaaatgaaatttgggtggggacacagagccaaaccatatcagacaagaactacctaggtgataattctaaatgaaagttctaccttagaacaacactgagaaagaataataagaaagctacttaatttgcaacaagcaagcgcaattatataaactcttctttcttacctatggactgtattgaaattttggtttcatttaaaatatctgtattagttcaggctgctccaaccaaatgctgacctctgggctataatcttatcaagaacagaaatttctcacagtttcggaggctgggaagtccaagatcaaggcactgacagatttggtggctagtgagggcttgcttcctggttcataaacagccatcttcttgttgtagtctcacatggcagaagaggcaagagagctgtctggggtctttcttacaagggcactaattagattaatgagggttccaccctcgtgaccccatcacttcccaaagatccaccaccaaataccatcacattagggattaggcttcaacatatggatttgctggggggtggggacacacaaacattcagtctctagcagtatctttgctcatttcctttttaccaaattttgttttgaagtcttcggtttattttcttgtgcttgctgttctaccaggacttgctgggtttttctgatttgggatagcttctttagctgcttctacattgaaggcgaattttctatccctagatgaggctgtcctgtaggtaggcaggccaatcctcttctttcattttctcccattttcagtttttgctacctaagactctatagcccagaaatacacaggttcagagcaatgggctttttttgtagcttattaaataatcttcatttgttcattggtattacatgtttctaggatcttctctgtgatcagaagcacataaccttgttagttattcttgatgaatcatattgctaggcctagagaattcttcgtatagagagttgaaggccaacagctcacctctgcagaggactttgatttactttactttgtgaccaaatataggaaataccttctggaatcttttctcattgtgaagccaaccagctaaagaagagattcttctttagacaggagagaacatggatctcgggcatcttttaggtttggcaactggtcccaaagactgcagcaagacctagagcttccagctgaggcaactatttgcatacacaggatatttacaattcagaaatacttatctatgactaaacaattacgttttaaaagcaagtatgtacttctttacagaaagaaaattttgtgaaaggttttaacagaaaattttttagcaagtttcttttagtacttttagctaaaccttgttgtttaaaaggtattctgtacttacagttggttcataatttatttttcatagggacagtcttataaaaattgtgaaatgtatgaaattaatttctaagatcctaagtcctttattttatgacatacagccaacttttccttctattattaaaacacaagaaggaatctaatgaagttattcctaattctgtgaataaccaggaaggtttatgtcttgaaaagcatttataattttaacagaaagaaacttcagctaacggaatacatttttctgtgtgtgtatgcatgcatgcctgcttacttttgtgcacacatgtgtgtaattagaaacaacagtgagctgacagaggcatcctttagggaggaaacggaatcagtgttctgagagttctctctctcttcctgtatgccatcttcctctgtaatatgtttggagcctcatcctcatgtatcagtcacctgtcagtgcatgtaaaatgggattcattatgccatggtgcagatttaaatatgtttcttggaaaaagcaaaatttgtaggttttcttttcttttgttttttgagatggagtctctctctgtcccccaggctggagtgcagtggcgcaatctcggctcactgcaaactccgcctcctgggttcatgccattcccctgcctcagcctcctgaatagctgggactacaggcgcctgccaccacgcccggctaattttttgtatttttagtagagatggggtttcaccgtgttagacaggatggtgtccatctcctgacctcctgatccacccgcctcggcatcccaaagtggtgggattacaggcgtgagccactgtgcccggcctaattggtaggttttcattatttttcagaacagaaagggagatagatgagaatacgattcactggttattagagaatattttttttttggacccttgataggattgggacatacgtaagactcttcagatctcttctggtgtggcttagaggtactgtcctgagccctttattggggcttcaggatgcagggtttgaccctgacttgatttcttcactacttgtaaaatctggttgtggttgaaattgtagtatctgcagaatagctgtagagcaggatttgcacattgtttcctccaagctcagattaggcttttgtttgttggatgttcttttgccttaaaaaggagtctaaccacgattatggaccaaggccttcctctaagatggctacaaattgtgcgtattctatagtaaaatagttctaaaaccagtcttccagactttcttataaagaagtcagaaccacaggctgccctggagcatgcattgtagggacattgtctaggcttaagttttgtgttcccatgtattccaagtccttgaatttggttgattcagaattctctatattattttgatttctaaatataacttctacttagcctttatgattctgaagattcctccccaagctaacctgtgtttaattcaaggctttactagagttttgcttgtagtttagatttttttgtggcccttccagtggggagtagtaaatgatgcctggtgtattttgctctttcctctttgttctctttagtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtggtgagtacctgatttatgaatggtcgaacacgcatggcgagaatagtgagatttacttggtcttagcagcattggtactttacatggaggaaggggacccttggtcacatcaccctacttttcaagctgggactctggatcactgtggctgtatggaaggttacagctagctgggagaggcatcaccttcttattctgctactcaggtattggtgaaaaacagccatgagtggtggagaggctgctgtctccagacttccagtacctggtacaagaaataccaggttaaacttctaggtgagactgatcatcttactctaatgtggttctcacaatgcaattgcaccaaaatcacctggaagcatttactgaatcaagagcttgccagatcagactttcagggttggatctctgttctgacataacatagaaaacagttggttatatgtagtagggtcacatccacacgcaaagtgtagttggtagaactgtatatctttgctctctgaaaccttactccaaggaagatgtgaaccccacacctgttgttgtttgtctacctttttaatagtttgttgtgtgtttgtgtatatgtagcacctaagaataaacatatgcagatatggcagtaatataatcatgctttatactgttttaggctcttttaaataaaatctttttgtgttatcatttggatatttttgacatttattttgtttatccaacatgatttaaatataagacatgctatgaacaaaaagcctcagagcattttgtgtatcttctgtttattcctgaaaataccttttggtttctcataattttttcctgctaagaatgcggtttctcctcattttaggtcttatagacttaaatcagggtctaacattgccctcctttgtatgaaaaatttaaaaatatttgtttgactatagtttttaagtctctttcatcttctgtaaccaaattctacttttgtgttggtttttcagaggggagaggaatacttcaagattttctaggtagaagaaggacataaggatgactcaaattggctgcttcctccttttaaaaaacaatcaattctgtactaatttgcacacagtatggatagtttatataattgcataaatgtgatcattttatgtatttcatttttatgacatatttgcttaaaatgatctgtgtaagtcatagggtataatatctaaaatgatcacctgtgaaccttccatcagggtttctttttaactccttgatctctttattggttttgttctgtatgtgttggtacttgtacatgtttatttctgtttcccttgatgccataatagagtgacagttttagacattggagtcccattgttttccctgagtaggttcatagttccatgtcattgcaaatcattaaggtctacattgaagtgtacttatgttcataatatgctcatattagctctccacatttgtccattctttctgccactctttgtcttggacattgcctgtaatctctaacctggatcattcagatttctcataatccaatattgattttcttataatccaatattgtcttgttccaaattattcccctttttattagagttgtattttttatgatgtatatctgatcatgttacttctctatctaaagtatgcattcttagcagggtgatattgaccctaaggaggcaaaaattgattttggagaaatgaaaatcttaggttgtataatggtttttagtcctccaaagggccatagaatataaacagatatgcactatatctatcatatttaaatttcatgatggggaggataaataatgaaaaaaatactgagagatactattctatagagacttcctcttgtccttaaaattaattaatttaggctttcagaacccattacgatctggacttagtttattgctctggtcacatttctttttttttttttttttctttcttgtttttttggagatggagtctcagttgcccaggctggagtgtaatgatgtggtcgcagctcactgcaacctccacctcccgggttcaaacgattcttctgcctcagcctcctgagtactgctgggattacaggcacctgccaccacacccagctaattttttttttttaagtagagacagttttcaccatgttggccaggctgatctcgaacttctgacctcgtgatctgcccgcctcgacctcccagagcgctgggattacaggcatgagccactgcccccggcccgctctagccacatttctcatgacttccctctccttgaatggtttctgccaaactgaatttcttcagttacataaattaaaagcacatacaggataatatgggagaatgttttcattacgtttgggtaaagatttctgaaacagaacgtagaaagtagccaaacctaagagaaagattgattaaaaaaaaatggatttcattaaaattaagaacttccattgattaaaagacagcactgaatgacatgccaagccacacagtagaaggagatatttttcatacttatattcgacgaaggacttttacacagaatatgtaaagaatacttaaaaatgtaaaacacttatgaaaaataacaaccaaaaatagcaaaatacttgaaaggcactttaaagatgatattcaagaggccagtaaacatattcaatttactgcattcattctgcattattagtaatcaggagacatgcaggtcagaactacagtgaaataccactataattaccagaatgaccacagtttaaaatactgacagtaccaaatattggtgaggatctgaagcaactggaagtctcatacataacttgtaggagtataaattagtacagttcctttgaaaaacaagcagtatccagtatagctgatctaatatggttgatgtatacaccatggttcagcaattcaagttctgactatatacccaacaaaagtgtggacataaatacactaaaagacatatgtaagaatgtccggaaaagcacatttataacctacaattagaaactctctccacagtagaacagataataaattgtagcattatgtatacagcagtatatagcatcagagaagatagaaccattgcttcactcagcaacttcagtaaatctcacgaatgatgttgagtgaaagaagacagaaagcagtatgtatggttctatttctatatgaaagttaaaagcaaacaatataaggtattggaagtcagaatattgttactttttagttctgcacttaggagttgtgttttctgtatgtctgcttcgattaaaagttttcctaaggaaaaaaaaaaaaggataagacttaatggttcaaaaggaagaccttgccgactgaggtgtctgagcgctcagcattgggaaatggtcgactcgtgggttgataaaaagaatttacagacaacagtataggtttgaaaaaggaaagtttattagaaagaaagtatgctgcagaagagtgcagaagggtgctgagcgtgccacagtggatttttccttaggggtatttatggaccttaaagcttgaggataatttggaccatattagccatgtaggtaacaataaatgattacatttgtagtaattttggttccttaatgtcagcaagtgttgcacagtgaatttcgacatggcattctggagatgtatagaaattctagttacttacaaagtttttttggggaaaaaatctggaaccaatgcctgctttagataatagggaagtctgattacttcttgggttttgttgttgttgttgttgttgttgtttttaatatggagccttgctctgtcgcccaggctggagtgtagtggcgcgatctcagctcactgcaacctctgcctcacaggttcaagcgattctcctgcctcagcctcctaagtagctgggactacaggctcatgccaccatgcctggctaatttatgtatgtttaatagagatggggtttcaccacactggccaggctggtcttgaactgctgacctcaagtaatccgcccgcttcagcctcccagagtgctgggattacaggcgtgagccactgcgccaggctgggaagtttaattacttctgattttccccagataaggaattttgcttctagattgcctgttggatagtcatcgggtggtttttgctccttctgcattcctcagataaggaatttttgtctctagggcctgttcagtggtcaccaagtgattttgctctcctcagatctcagcccatattttaaactgtttcccaatttaactatctattgaaatcaccattggaattttttttaggggaaaaattctttatttgtcctgggggaagaaaaaacaaaaaatgttattcttgaggaatttttgtgaaactctggatggggataagactgaattcagggatggattgcctaatccaaaatttatcgtgtgcagaggggaatataaaaagtcactaggacgatataagacccatatacaactctgtagcttgggcagcagacctggaagaagaggcaacttgtgggactgcctaattgtgcaactaattaggcagtaaagctcgatcctgaaatgtcttgaggaaatgccttctgtgctagatctcacaggcagctgggacagtgtagtagtatctactcctgcctttctcttagcagcaagacctgtaaagaaaagctcaagctttgctgaaataacttctaacaacaacgcctgtgttggttagagggcgggagcacagtgcatgctgttagagcaaatgcaaaaattaaatccctatagtaggtgatgatgctgcagtgatggctctccacctaggtgatgatactgcaatgatggctctccacctaggtgatgatactgcaatgatggctctccacctgtttctcacagttaacctgaatccatagctgagattaactgtgataaagaaaaatcactaacagatgaaaactttcagtgattcggagaattgtacctaagaaatctaaacaaatatttcctttaaaatgtcacagaaaaaaaaacaaggtaaaaaattgtaaggagggaataatttgaattccagaaacgttatcttcagatagtaaacatgattcctgaactgaatgggggaaaatggtggcacacagcagattgagtattgcaggttaaccagatctgtaagtaacaccgtttagttaatctttaagaataaagggctaaaaagatgaacatgaggtaaatggtaagagagaagaaaaatccaaaatattctatttagctgattgtagacaaagaattaaaattaaaattccttctacttgaagaataactcaagttcttagattaaaataccagaccaaattaaacaagagagtagagggaagccacatctagatgtgttctgagaaaagataagacttgacaagttttcaattaaaacacatgcacacaaatgtacacaaaacaccaagtcagcaatacctgaagagcagagaaacagctataacaggaggaatgtggttacttcacattactttggtgcattagatatcttggacaacacttgcactgaaactactaaaatgctggataagctttttattttatttattttgagatagggtctcactcactctgtcacccagactggagtgcagtggcatgattgcagcttactgcaacctcaacttcccaggctcaagcgatcctcccatctcagccccccgagtagctgggactacaggaatgtgccactacacctggctaatttttgtttttttgttgttttttgcttttttgttttgagacggacttttgctcttgttgcccaggctggagtgcaatggcatgatctcggctcaccgcagcctcaacctcccggtttcaagtgattctcctgcctcagcctccagagtagctggattacaggcatgcaccaccacacctggctaattttgtatttttagtagagttggggtttctccatgttggtcaggttggtcagctcttgacctcaggtgatccgcctgcctcggcctcccaaagtgttgggattacaggcgcgagccactgcgcctggcccacctggctaatttcttaaaaaaatttttgtagagactggatttcactgtattaccctggttggtcttaaactcctaggcttaagcgatcctcctgcctcggcttcccggagtattgggattacagtggcgtgagccactgtacctggcctggataagcattttaaagtgccatttatttatttaggacagagtctggctctgtcgcacaggctggagtgcagtggcatgatcttggctcactgcagcctccacctcccaggttcaagtgattctcctgtctcagcctcctgagtagctgggactacaggcacgcaccaccactcccagctaatttttgtatttttagtacagacagggttttgccacgttggccaggctagtctcgaactcctgacctcaggtgatccgcctgcctcagcctcccaaagttctggcattacaggggtgaaccatcgtgccccacctaaagtccctcttaaaatgtaaaagagttggtgcaaaactgaggaatccatggagctctgaagttgactgaaattcagggagggagattatgggagagaaggaagagtcaaagtaaattaaaggataacccaagcaaatgtagatttgccatctaaattcatattgaatatggtaaaaatacttagagaatttaattttaagaaaaattacttttcagagtccctggttggaaagatatgctcctcttgcccccagttgatgggcagaagcaaaagcaaatcattcagcctaggactaaatgattccaaaaaataaagtcaagtggaatatgtagtccacaaaaaaatctcaacactcacaaaagaaatgagaatcagaaacaatggatagtaggaatagatctgcaaaggcttcaaatattggaatgaaaggaaacaaaaaataagtttaaagaaaaagaggcagcttagaaatataagcagggaacacatttataaagaaccaaatagaacttctagaaataaaaagcataaattaaaacaatagctgcattcaacagattagatatcattgaagagagattaatgaactagaagacagagctgaagctctcccaataaaactttttgagatgctggaaatgtcctataatctgctctgtctagtgtggtagctgctggcatttgaaatgtggctaatgtaactaaggaaatgcattttttattggaattaagtttgctaacggctaccttattagatagtctaaggggagctaatataattattgataacattattagtgtcagctgtaattcagaaaaagaagacagtcaatgttaatagtttaagatttcaacccaaatagcatcataagtttatacactgacataattttctgctccagtagatgaaatagaaaaacacaaaaccagaaaggtatggcagctttacaaagaaagcaaacctctgtgtgggtgaaaaaatgcaacaaaaatactgacagaatgctgtgtagatctgatgccatggacttgctgtattccaggtcatttttcattctggagaatgaaaaaaatgatatcagttacttcctgggccacagctttaagcaagctatggtactacacaatgacaaggctttagatactggttttgcaaccagaggactggaactgtaattgtcctaataccaacataggagtggaacttgaaaggtccattacaggaccctgtttgatactggtggccctgtgaaatagaggcaactgtaaaactgctctatgtgtgtatccctggctcccagttcagttcatagtgattagtggggcactcagacatatgttgaacaaatgaatggatatgcatggagggtaaacatgttatttcaaaatgagtctgcaaatcataattcttgaatactgaagtgtaatgctaagaaagcatttaacaaaatggaacagaaacttactttaagttgaaatagatttatgaaattgtctgaaatatgctgtaaaagaaaatcagtatatttaggatgctcaaggaaataaaggtataaattcaattaaaactgaggaagaaataaagtggttggaaatagaagtcttggaaatggaaaaatcatagctgttgatataaaagacacaacagacttgatgttctctagactggaaataattgaagacaaaattagggaaataggagctgagacgttcccccagcatggcacagattatatgaaaagcagtgaagaatcagaacagattgcagagttagaggttctaagatgcatgtaatggaaataaagaaggcaactctgaaagtggagaagcaatgtttacagagatcataggggaaagaaaacatttgagaactgatttagtataggttttcagattgaaagtgaagtctctttatcatgtaggataaacaaaggtataagcttaaaggtaaatttaaatataaatttaaaagtaaattttaattgatattctgtagttttgcttcagtgcataaatgataaacaaaggtataaatttaccttttaaatttatatttaaatttacctttaaatttatacctttgtttatcatcatttatgtattgaagcaaaattaccgagcaatatcaggaagagaaaacagattatctgttaaggattgataataagactaacagcagatttgttcccagccacaatagttgcaggaaaaagtggagtcacagcaccagagtgctgagggaaaataattgtcagcctggtcctaaagttttagactcagacactcaaatattcacagtaaggaagaaatacagttttaggaatgggaagactgagcacttacaatttatagactgctttgatccttgaatggtgtggaggttagggatgctgaccccctgtacagtcaaaaatccgcatataacttttgattaccccaaaacttgactactaacaaatagcctactgtcaaccagaagccttactgataacatagttaacatatattttgtatatgtattatatactgtattattacaatgaagtaagctagagaaaagaaaatgttattaagaaaatcataaggaagagaaaatatattatttatgaagtggaagtggatcatcataaagatcttcatccttgtcttcacattgaatagactgaggaagaggaggagttggtcttgctatctcgggtggcagaggcagaagaaaaatccatgtataagtggatttgtacagttgaaatctgtgttgctcaagggccatctgtacttgaccaagaagagaagttaacccagaagaaggatgtcacaggttggatgcctggaaagcaggcttttgagacagagataagagtgtaggaagttgactaggtagtgatcttgggatcaacactaccaatgagaaggaaacgagattgggcagaagaagttcagttgcagtgccatgtcattgaaggcctcagccaactctgtgttgacctgccttggaatgagggtcttggatttttattcacttttgtggatcagtcattagagatggactgtcccaggagggctaaggtggctgtctttagctgtggtaatcctgaagaggccgatagtaaagggttgtctgctggcggcttgccccacagtggaagaataagtccttccttcttaaagagggaatctacatagcacattgcagtatctgttacagaaggtgtgggatatggaaaacagcaatgagtttagaaagaggtgaactatgttacccatattaattcatgtttgatagtaaaatattaattgaggttggaagggaatggtgattaagatatgggccaagatagatgaggtaaatataaacaaaatgaaaatacttttggcagctttaattaggcaaggtagaattcaaggagaaaatgtcaacagagcagacatttttatatactgatgtagtcttcagtgaagttatattgttttaaacttttggaccaaagaacatattgagatacagagtataaacttttttaaaacttaaggataaattgataaaaatgtatatgtaatttatctcccagaattacttgattgctggtttctcttgggtagtatctgcataaatatctgtctacttatttatttacatttagaaaagcatatatgtacacaaataattttatacttataaaacatttatatatttaactgtagtattctgtgtagctatgccataatttagtcaattttcaagaattaatattttttctaatttttaactaatcatcctacactgactatcctagagataaatcttcagattatagactcacaattttttgtatgtgcttttactgtgtttagcaggctgtctgcgttgttactttggatctgaaggaaagaactatttcattatttgtaatatttcatctgtgaaaagaaaaatacttaggcaaatgaatctacattttaataatgttatttttatgttattttagccttacgaaggatgaatccaaaaggccaaagtataaagagcttctggtgagtgtgggactgtggggattgtaggtacatcctaaccccggaactctcttaacatgctggttcactaagcaagcagtgggcctctctgtcataaacaaacatctcaaatttattgagtgttttttgttaatgtttttacacaaagatttggaaagagaaaatttgcagttataatttttctactaatactagctaaattctcatggaaaattttggtcttaacatgttataaaaattacccccaaagaattctgactttaagaagccattttccactgcatagtctatttatatgggatgcagccataagaaaaaaattagtgaaaatttgtgtttattctgcctttataaaattcatgcaaatttacgtcatatagcctattcccatttctttgaaagttctcattcatcccatggaacttgggtgttttaagcagtctactgggtatggcattggtggggcagggagaaagtgttgtgatctaataatgtgggaatattttaagaaaagatccatttgtttgtcacatttaactactagctcttcaaggatgttgtgacaaacttatatcacagtccaccaatgactgtaaaaatatctagtcaacatacttagtctgtaaaagaaaactgttgctagagatggagttttaaaaggtgggttagtgaagcagatactgggaccctggctctggagagtacagggaagaagctcctggggcaaatttctcttgggcctcttttggtcaaaagaattacagcctttttgttaaaaggtcaaaagaagaggtcaaaaggattgcgacctttttgtaaaaaggtcctcctgttgtatataggagaaatggaggttgagatttatattggtgtcccaagaggaatagtgactggcatttgcgtcattcttcttagctcttagatggtgtggtggaggctccagctatgttttgtgctgagtgacaacttggctgtcttcctcaacaaacactccctggtatacagatgagtttccagacctcactgccaaggtggcaccttcagatcattaccacgtatcctctctctaggcatgcccatgcccattagcatatctgcatggaataaaggctgtactcgcctctctgaacttgtagtgttgcggtatttcatagctatgtgtggttgggagcctggagttctatgttctatagaaattggaaaatgttcagtttgggctgtcatacaaacttttgacttttttgttttcaattttcttgcagaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagggaaaatgacctccttttggaagtgttttatggctgctttctttttcttcttccttcccatggctaccctttttgcttatccttcttgaaaccacagatgtatctgttaagcatagctttgcttgaacaggtgtcacagtctcttgagtttctttgtttgttgtcctgacctgccccagcattcttaatgctaaaggaagtgggtacagttcttcaacctgtgtcatggtggagaggtacaacttataagtctatctgggccccgtgtatggtttccagccatgctctccgctcttggtgcttcagctgccaggtgagcattagatgtcaggttagatactgggttggaatcactcactgttaccttagaagggtagggaggattgtgggtagaagacgtctggaggtcagacatgggaggtttatggatgagaggacaatggaagtgaacaaaaagccatgggagcctgaaaactgttggagaaaagcactttgcggctccagcactgaatgtatctgctgtactctacctcctaccagtgattgatcagataacagattcattgatattatggtgattcagcaccttgcccttgtgcctgctcctaactgtacctgagatactattacacagccagatgtggtatcaaacattcccctgagaggggtgtgaaagcaggaattctggcctctccagctaacctcagctgctaagggaaagggtacccattgggtttcaatactggcatgagagatagactacacactccatgtttcataggacactgccttgtatttgttcatctcatttgattccaaatgcatcccactaaaatcaagtggctgtatccccttttagatacaagaaaaccaaggtccgaaggagtgaagttctggctcaaataacagtagggagcagagctgagattcaaattcaaggccgtaacacgtaccctaagaagttacattaatttaaaaacactgctattaaagaagtgttgtggagttgagaagtggaagaatgaatatagttgaggatactctgttcataaacctgaccagggcctgctttgttgttttggaaatgagttgaaggcagaggttctgggggccacagtggggcttaacatacaaagcgatccatacaaaggcaactgtgtaattaccttagaattaactagaggaactctaggttgtaattcttcagtgcaaacacctgagaattcagtgtcatggactgaacgtctccattagcatgataatgtggcaatcactgagaatgagtaaagtgccctttcatttattttatttattttttattttttgagacagttttgctcttgttgcccaggctggaatgcaatgatgtgatcttggctctgcaacctctgcctccggagttcaagcaattctgcctcagcctcccgagtagctgggattgcaggtgcacaccaccacacctaggtaactttttcttttcttttttttttttttttttgagatggagtcccactcttgtcgcccaggctggagagcaatggcgtaatctcagcacactgcaacctctgcctcccaggttcaagtgattctcctgcctcagcctcccaagtagctaggattacaggcgcctgccactacacccagctaattttttttttgtatttttagtagagatgtggtttcgccatgttggccaggctcgtctcgaactcctgacctcaggcgattcacctgcctcgccatcccaaagtgctgggattacaaagagccagcatgcccgacttccctttaattgattcgatccaactgtcttagctgcaggaggatagagaaaggacacataaggtcttgaaagtaccgttgggacactggttacttttcttggcagtgtgtagagattatgtgtctccatctcttgtgcagggctgtctgcaccagtcacatccattgttcctgggcttattgcttgggatgtgagggacagagaatctaaaggctttgtcttaaac

SEQ ID NO: 4 - DNA, 88080 bp, Homo sapiens
gcagcacatgactataatttatatccattgcatttcttatttcctgaacatacacatgtggattatttttcttatatattaatcctgacctaatcaagcatttaacaatccataaaactcattggtgttaggtactatagttctaggtctgcactgtccaatacgtcagctacctgtgacctttgagcactcaaaatgtggctagtctgaattaagatattagaaatggtcagtgtaaaacacacaccagatttcaaagcgccagaaaagagaaactatctcattcgtaatacgttatacattgattgattactcgtggaaataattttttggatacgttatgtaaaataaaatgcattattgaaattaatttcacctggttttaaatgtatctactagaaaatttaatattatatatgtggcttgcactatattttgttagacagcactcttctagtgcatgataatttttgaaaatttttatttatttatttatttttagagacagggtgttgctctgtggcccaggctggagtgcagtggtgtgattatgcaccttgcagtctggaactccggggcataatccaccgtcccatctcagcttcctgagtacctgagactacaggtgtgtgccaccatgcccagctaattttttttttaatttttgtagagatgagggtctcactatgtcacccaggctggcctcaaactccaggcctcaagtaaccctactgtctcggctttccaaagtgctgggattacaggcgtgagccactgtgcccaaccccatgccaactttgtatacctctttatagcagctttggccataaaacaatggaaatcaattgcaaagtgaaggtgcaaatgttgcaaaagatgcagaagtgaacagagccaatgaaagtggtcctgaactgctcaggtcacatgcaaagccttgtgaatgcaggattcagcagagttggaccaggaagttggtaaaaggaagaaaaaactgacaaggacactagtctaaaaaaagcaattgagtattacaggaggatcttgggaaaatgtatgaacccttcaaatattgtttgcaaaaatgatagccctcactaagccacaaaggtcaaatggaaaaagagtatctcagcatgcatcaaaaaacagcaactacgatggccattcaaagaattcagagaatcagtgcaagattgtaaagtgagaagaattttgcttactctgaggcaaattaaatttaataagttgtagttgtgttcttaaatataaaatcccaagtacttttcattatttattacaaaaattaatttctgattttaagaacatgcaaatacatgcaaaatgtttagaaggtttattaataagagggaatcatacgtatctcttaagtattttactttagcttaaaacatataaacaacagtgttttgttttggttggtttggggtttttttggtcaatatttggctgtaagtctttagtctttaaaatgtgggttcaccgtttagagttccatgtatctttcacatcatctacaattttcagttttagtttttttaaagtgactactgatagatacctgcaaagtaaattcttcccaatctttcataatggtcatacccacaactaatttgacagattttttcagtgcctcgcctcaaatacttcctattaacatatggtaaaggaagaacaccctttcaattaagcatgtcctctgatcatttttctcttaaaaaatcagtgtgtccatatgcaaatgcataatgacaacctgaatattcacataagtgattaaaataaaaatgactagaagcatcaaaaactattggaaagactggcacttaggtttccccgtggtggtatgcggtggctgggaagaagttagagaattgttaactagttgataagtgttgcactgggtactgcctcactttgatccccagtttcaatcacttttctctcaaagcatttcacttcattttcactggaacaactttcttttcgcacacacatactcatgtttttaaatttaataatcaattgtgtaatatttaattaaatttcacaaggaacattgtaataggtggaatcaagtttgggaacaagcacaatggattctcatgggacccataactcacctagtgggaacagaagtatgcaggtgcacaccagccgctggcctgagcatttattgtgctgtatcatccctctgcatgttgtacaccacacagtaatggctggtatctgttactggatgagtcagctaaatggaggctggttaagagaccttctactataatgtcatttacagtgcccttgtagggaaccaattatcccactgatgacaggattttctgacttagaacatctgaaaacacctgggaagtatgttgtctggaaagaacatgcagaaaccaaattctagccccagcactcctgcaagtattccataataaatatttgtaagcttgaaagaacaccagcttttaccctattctcaaggttatattattcttttatgtttatctgaggtatagatctcacaaacagccatgaatatgtgaatacattcacatactgatggatctggaattctaccagtcagcctgataaatacccactaataaaaatatctgtagattggaatattttgtttattcatttttgtagaaatgaaaaacaacaaacaatatcctcagagaagaaaaattcctgcatatgcacagtaggtgcttactaaatatatgatgaatgatgtacaggctgaaatatttctcccaatgtatattatgtctgctcattctaatatttgtgatatttatgtacagtgaggaaatgcccagtgtcaaagtggatcctcaacgtgaatatgctgcaggaactgaagtgtgatgtaggcagtttccagaagcactatgtggaggcagtgatctgtaatgcactggtattaaggttattgaaatggtcatgaaattgccatgaaattgcatgcgtgaaatcattgcaaggtttacgtcccagtgaggatggaaatgaagagcttggaaacaggaattggagctttcagtctagaaacaaccttggaagaaatacaagtctcctgaatgttattaaataaatcatattaagagaattcagagcctacagtacttgatatttgacatccacctctctgcagtaacatagcaggactgaagagcaccaaaaccagctagagtcttaatcacgcattagactcagaaacttctattaacatatggcagagggagaacacccttttcagttaagcatgtcctttgattctctctttaagaaatcagtgtgtccatatgcagatgcataatgacaacctgaatatttacgtaaacaaagaaaaaaatgactcaaagcaacaaaaactgtgggaaaataccaacacttaggtttctccatggtaatacgtggtggatggaggaagtgagagaattgtagctagttcatagtgctgcgctgggtagccctctccctttgatccccagtttcaaccactgtacaaacagtcaaaaatcagttttgctggaatctcctttttactctgctactctggctaaagtcttccacttacttttctcacttacaggtacctgaatatgtgcgtgcaaatgtaaaagtctttagatcaaaataggaacaaggaaagtttatccgtttcagtttaggatttggtgggtgtggcaacccaggaagacctgagaaataaccactgtttggtttgaatgatacatttgactgccattaaaatagcatataattatagcctaaatgtagacttaatttttaacagatttatctgaactttcaaaatttgtaccgttgggtgtaacgatctaaaactatcttatgggagatgttacagcagttttcaaatcattgagctaatatgaaatctggactttttaaaacccctctgatctaacctggttacgcagttaacattgtatctgggaaaggggctttcattttacctagtctccagaagtcaatggaattattctgtaaatagttcaggcttttgtctaaatatgtgaagactgacaagactatctccgtgagaatccgcacccccccaccccaacctcccccctccttaatcatgtttcacaaagtaaatctatagacgttcctcctgggttttgggagattccccatcctaaacaaaccagctggaggaaaggaaaggaaggaagaaataaacgcaacacagaagttctcctcagttgacaaaaggtcaaaaatcattaacgtgtaaatgttgctttttccatcccaaagcaccttctcacgtagagtccagggactaggaggactcacaacgcagcgatgggcagccaggccctgcaggagtggggacagagggaacccggccggtggcccgaccctgcagggaagaaggacgtgcggcgagaagcatcggattcggggagggccgggacctggccgagggtgacattaccgagcacttcctggcacagcgctggtcccctccccaaacgcgctatatgtggttctgtacgggactgcctttcccaaagacagccaaggaaaaactaaagatcgacggggacacccgcctcccttcctcgccccaacggtttctcagaggctgtggggacttggtgagggtagggggtagttgtcccaaatcagcagcttcaggatgtaaggtattacagaaaactttgaagttttgttatctgtagcacagggacaggggtgggacaatagagaaggaatgttttcttttcaaaagaaaacacaaacaaaactttatttttctggtccgcggcagcctgtctgctgaacgttgacttgctttcgctttgcagcaggcgacggtcccgggcgccacctgcgcgtcggtgggaggctggtccacgcccgggtcccccgacgcccactgcaaagggcagtgggaatgacagactgtaaaccctctcgcctgcgtccccttcaagcaccagaaacccaagttggaactaattctttctttcggaaggtgcaactcccctcccgcgagctccgcggtgccgggccgagattgccgagaggaagcggcgcagcgctgccgccaaggctcctcctgtcgccggtgcggccgggactacctggcggcgcggcgcgtgcagcgcgcagagtcccgggagcccacgcctccgcctccgcccccgccccctccgcctcccagtccacctcgcccgcccgccctctcgcccggcggagagcacagcccactccctcccacctgcggccgccgggccgccctccacccacacctctgccgcaggccggacccagtgcgcccgcccgtcggtcagtccaggccaggcgcccggcgggccgcgctcacgcagttggcgcaggaggccttacgctggcggcgcagtgcccgccccctgcgctctccccgccccctccctccctcgcaggggccgagcgaatgtagcccgcgagagaaaatggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccgggtgagcagcacggccggggtcgcggcggggacttggagagcgggcagagggcaatgaatgaaccccgggcaccatgcacggcgtcccggggttcagcgcagcgaggctacgcgccgctcgccgggacctacgcccctgagcaccccccgaccccttcggagtcgggcggcgccccggacccagcctgggggaccggacggggacgtgcggaagagtttgttattgtttgcagacatgtgacaggcgtgcgagcctctctgcggggaaccgttgcgaaaaggtgtagggggccacggctggctttgtgggactcctggaatcggggctctccgaggagcccgggggcggggcacggccctgcggcggcgcccccggacgggtgtccccggggcaaaggcactggggggcgaggcccgagcctgaggcgggcggtggtcggaagaggggcggggtgggtgagaagcccgaggtcgggtgggagactgagaggaccgaagagaaagtagcaggtcccagcggccgtgacaggcagagcccctcggcccgcccgggactcgagtccctaggcagataccgcgggctgggcccggacgcaggcggcgcgcccccagcgccggccgcagggctccaggaggacggctcggtaacgcctgtcaaagccgtgcggcgggaggctgcacactcgcggaggcttgcagtcttttaggaagtgcggtttgtctaattgcagcccccaaggggctttgagtgttcctgggaatgcgaactgcactgctaagtcacttgagtgacttctgtttggagtttgaatttggcctttgaagtttgcatttggcggagtggtgtaagagccaggaccggatgtgtcagccattcagtttcaaagcagtggtgactgctccccgcagcccctccggcttggcccggggactgcggcgcgggtgcagtgcttcctgctcggtgccctggcgcgggccgcccgctgaattccaggggccgcagtgcggtgggcttcggctcagatgcgtcttctggtgcatatgaagtacagtatgtgtaaggtaatttagaccagcggtttattggcctcgcccatttttggctactggaaatttttatgttaaaggaaattcttttaagtgtgacagctacatccttgtttgtttgttttttaaaaacctgattaacgtatgcaaagtacaaagtcttgatgggtattttgagttgctggaaatgtttttgtgatagtccctcgtggccctgtagaattccctgacctttattatgagaagaaagcgtgtcattttgtgagacgaatttgacagtaggagtccttggtttggattcattatctaaagtgatctggcattttttgtgcatttgattatttgcttaaaatcacgatccatttagtatttggaagtccccttcctctccccaagaactaaaaaatatgcttcgcactgtaccatggcactactgagaccaaaggagatttgtgactgatacagttttgtgtgcacttgtacatgtaatttattcttacaagagttatgtacctctatagttttcccatttctgtgcagattgtattaaaacttaactggaataattctttgaaggcaacttctactttaaatgaattccagataaaaatttttaaccccaaatttaagaaattgtatctattgagacctaactttttggatacaataaataatttagcaaacgtcagcattctagtactcttaatgagctgtgaatatagtagaagagcatccactgtaaaaataatgtactgaaattgtttaatgttgtctcttgacacaaaataagaggactaaggtggaggcagatagaatttagggactaagtaatccatgcttagtatttgcgttttgtaaccgaggttttttcccctttgcttaaggtgtagattataattgcacagtataagaaaataatgggcttgtaaggataatcttttttaaagaaattatttttacgagtcagaatgctgttggtttatcccaaatgtcatacgtaaagatttcatttatagtaaaatgttgattccctaaccttatgaaatatagtgaatttttttttcttaacaattgggttgaaattcatttgaatctgttcgtataaaactttgtggggaaagggcttgtatcttatttgagtgtgtatattttgtattgcatgttggttatgctacactattacttaccatttaaagttttaggaaaaaaaacccttaattatagccaactcaataaaatatcaattgaactttatgttttacttttttttgacagttaagttacattcatacttccaagaggaaaatctaagattttgaaatatttgagagttctgtgatcttttttttaattttagaatttccttctgatctttgaatgtagaaaatatactttgaattagaatttatataaataaataatactcgtatttaaatagaagattttaagtttgtccctctttttcagggtgatagctgaaatcagtgaaagtgcctgtaagtggcgcccaagggtttggaatttttccttatattacagaatttaggggctttttcttcctatttactgtctttgaagaaaaattacagtgttactctccattgaacagcctattgtgagtttggtagatataattaccccatcctatttttgtaacttaaaaaaccaaactatcaatttgctggccccgtgaaagaacaagatatgctgtacttgttaatgttagtttttgtttaaaactaaaggtatttcacaggctgcttttatatcctcatatagccctcagatttcacttcctttttaaagctattaggctaaaaatatgatttagtgaccttttactaaagaggaggtataagagcattattacctaaaaattactcttaaaatattaagtgggtgactttataaaaataaaggtagtcacataagttagtcttccgtgaatttgtaagtttttagttaagaatggtgtcagtttcattttaaatcagataagaaaattaatgcattcttcaaagatgaaccttaatataattctggaagagaaatataagagctagaattgttgccaacttttattttcttttcatatctgattttggcaagagtgactggttaaccaacattccttaatatacgatttccaatgcactaaaactccattttgttagatacgaaaaacaggaagtagccctgttcattgatattcatttacaacttccatagcacctcgagcataatatgttgcatattttagaaatggccactgacttgtcaacttgcagatttcaaaatgtgggaagaaaggagtgtttttttgctttcaacaagagcaaaaaaaaaaccagctacagcttgcctaggctgagtcggctaatcagtccttgacactggctgtgtgcatcccaaaggaagaaatgagggggtggcaaggtagttaatggggaatggattaccatgaggaaaaatatggggcattcagaaatgctctcaggtagaaagcacctcttttgcattttgtactccagtcatcttcttgggttgagggctgtctgttacacagaaggcgatgggaaaatgtgtcatggaaaagtagtagtctctagaggctgcttaggaactgcgtgtatattacacctctaatcttggaattctttgcttctatcaaatatatcaagtatagacttggttgttttccttagtccttgcctctttctatatcctaagttaaaagctaaagcaacttaaacatgtaaatggtagactattaatgtgaggaaatgtgtaagattaggagtaacccaaagttgtctttaagaaattatttaagaacatgtttaatcatgaaagaaataatcagggccggaattagtaaatggttcattgcaaagcatgagattagtcagatactcttttcagtttgcaaaaatatattaggattttatctgtggcttaaaacatactcattgagcatatagatatgcctagataccttttacataatcaactcttttgccttctgtgtgtgtgtatgatatctattatatgtattatatatatgtttatatataatctcatttgatcatcactgcagccccctaagatagtgtaatttctgttttctgtaggtgcaaactcatctgagatggtaaaacctcatgattacacaactagaagacagctaggattcaatcccaagtcagactgactccacagtccatttctttccactactctgcttcttccattttcttttttcaaattaataatcaaattaattgattatttttaaggagaaatttgttttgcaggcattctaatagaccatgagctaggtctctaccctgtgctaagtttgcctgttaatgtatataataggtatgtttctgtaacctggccttgtatatgtaatacaagtaaactgtatttggatcaccctatcatgtcagccaaagagggttagtcattagtgttgaatgtttcttagatttattgatttgtgctgtattaaatcataagtgaaaggagataagctgaaattaatatggttcattcatggtaatcacacaggaagagaaacttttactattgctagaccctacccctttgttattgttttagatttcatccattcaacatttatgaacttctgcaaggtggtggtcttgagtggtggagaaaaagatcatgagtgcacaagctgtttctgtcggtaggttgtagtatgaacatgtttcacaataccgtgttaagtgctataagagagatggggatacagaggggatacaacatattagtttcaaactatttctgcctattttctgataagaatatatacaacactgcatgttcaggcatgtttttttttcttccaagggaaaattaaaaaggagatacggggagcaagaaattcaacatctgctactgctagttctgaaattctgtctttattattagtaacagcaactctactagttacgaaaacaacatggagaaatataaaatattctttagggcataagatgatcaagaagatagccttgtctttatttactctatggcatgtcattggtgattgagttatgtttggtatggaagggagttctgtattgttagtgattgagtcctttggaataccaggctggtttgatgcagatgttaatttgatcgagatgtggagatgttgtagcatactaaggggaattgttaaaactcaccaagtgtataattctgcaagtacacatctgtcacctgggaattactaagccaccagacctcttgaagcctggagaaagtgcttggagccacatgggacagcctacacagtactgtagttagtacgttaactaagttcatcacttgtaagcataatgatggatagacatggagtgagaacagggtcagtactggggtgtaggtggaagctttgctcttgacagatgttatcattacttttctttttttatttttaaattagaaatgggttctcactatgttgcccaggctggaatcgaactcctgggctcaggtgatctttccacatagctggaactatgggtgcaagccactgtgtctggctttacttttcttcattgcctaaacaataatttaagttatatgttaacacataatcttcaaactggtcttatggtattctgaatactaaacatcagttgttaacagaccaggaactttatctgattctttgcaccatctcccagcatctagactagtgtctggcacccatgaatattaggtacccagaaatgttaacatgaattaattttccaaaagtggttaaattagtatatctgaagattaacttactgtagtgagattttaatcatgatctagcttaagacgagttttgaaggcaagaactgtctttttttaggagtttttgtatatcgtttggtatttatttatttatttttgagacggagtcttgctctgttgcccaggctggagtgcagtggcgcaatctttgctcactgcagcctctgcctcctaggttcaagcaattctcctgcctagcctcccgagtagcttgctgggattacaggcatgccccactatgcccagttaatttttgtatttttttgtagagacagggtttcaccatgttggccaggctggtcttgaactcctgacctcaagtgatccacccaccttggcctcccaaagtgctgggattacagaaatgagccactgcggccagaccattgcttgatgtttaatagcagtagttggcatttagcaagcagtcattgataatattgaccaattttatgtaatgtgagccttctaataattagtgtagttacaaaataattggagccatgctcaaactgtcaaatattgagaaaactgaattcctggtatttgaaagtgtctaattatttgcgttaattggtaagcccctcctgattttctacttaaccatgacacttcttccgtggcgcccatcttcattctcttgaacattgatactggaagattcccagggtggtcctaggccttctctcattctgtcttgtcgatccccaccccagtcttattaatgcccttagatcagttatggaccatttacaaatgattgcagagtttattgtcctaaccatgatctctcctaaagtccagacctacacctggctacatgacttctgcgcagtcagatgtctaaaaccaaattaaagatcttccctaaaccttctcctaacatgttccctgctcattaaatggcagaaccagaacccaggagtcacccttgacacctcctcctctcacctcgtcagattcagaccatccttaggtgctggcagtttgacctgttatcacacccctagccaggtgcccattgtctctcatttccactaacttagtggcctccttgcctgatccctgtgtcctttctcctttgctgtccgttccaatctgtattaggtggccagagtgatcatttccaaatgtaaatctgatcataacttcctccctccagaaaagtaaatgtaatttaattttaagatgttcagatggcttccatttggataaagaccaggaaatctttaacatgcctgaccgagtccctgcccggttgggcccctgtctgcttctccaggcccatctcagctcacacttgcccttgttccgtggcagggttgcgtgctttcatttcctcagactcactcactgccttcttctatagggccctcacatgctccctctgccaggaacactgtttttccataaagtcagctcctcgttgttaaaatcttaactcattgacacttcctcagggaagctttccctcatccacccagactggctttgtagcagggtgtccctactgtcagtgttgtgcttttacatttgttacctcatttgatgaatgactgccttccccctagcacctagcaggatgcctggcatagggtagacactgcataaatatttattgaataaatgaatgagagggataatggcatggcatgttcaaattagtggatccactgtttttcctgtttagtcagacgtagtttaggacatagctgaaaaggtgttaaatggcaaaagtctagactatggtgtttcaacactgtagatttgtgatagactcattcagaggtacctggacttgtagacgtgcctggtggctcgagtgaaataggacagcttaatgtagtagagagcaaatagctatactgcatgacaactttataggtaagaagagtctgctatgtgtatataattattctgtacttaatagggagttaagagtgcgtgtgtgtatatatatgcatttatatattcacacatacatctgtgaataaatatacacataaaggtgtcatgcattaatataattattcttatttttaaagttctcagaatgtcatctaaacttaagatatcatttttagaattcttatctgataaccctacttcatccaaaattcattaatttgatcataattcaacttgggataaataaaagttcacatttccattgaagaaaatatttgttaggcaagtactccatgagattgcagaagccaagaacccatgtaacaaaacatttcaaagtttactgttggtaagtaaacccagcagcctctcttatctagaacatgggttagcactaagaagtaagaaaaaatactctaagcagccaaaggacctgtaacaaaatatgtgctttgaagcactttgattttacacttagtagagttcccagggcatttgctcaggattgatacttatttcagatgttgttcatgcagtgttgttcatgtggtgttcctaacatgcagcaattagaagcagccagttagaaggggtggcggtgtgagtcctgcaagaggcaggttccccaaaggcagcagtgttggcacacctgacagtgagaggagagagggagaataggactcaaaacattgcagtcgggggccacctagcattggtacaattagttccatctagggcagcctctgccatttaaaaatatactcagtgaagtgaagttggaaagcttgtaatatagattaaggaaaattactatccaagatagttatagaaagtgtcttgatctttgaagtggtaaacctctaactgttctgtaagatgtatttctgtagccttgatgatactgaataaatatgtactttagaattacataaaaatggatgctgcttaccgaatgtcttatctattatctgtgtggagaaatcttttttgttattgttgacctgagtcattttataccttgcagtttctttaaaatgcataataatcaccactaccactaatatactgatcttttccggttttttaaaaaaaatttttatttttttttttgagacggagtcttaaagatatttttcttgctccaagggtctagattcttctttttttgttgttgttgagatggagtttcgctcttgttgcccaggctggagtgcaatggcacaatcttggttcaccacaacctccgcctcccaggttcaggcaattctcctgcctcagcctcttgagtagctgggattacaggcgcctgccaccacttccaactttttaaatttttgtatttttagtagagacagggtttcaccatgttggccaggctggtcttgaactcctgacctcaggtaatccacccgcctcagcttcccaaagtgctgagattacaggtgtgagccaccatgcccggccaggtctagattcttaaataaccaaatttcaagttttgtacaaagattgaaggaaagctagtctttaaccaggaagaaaaggatttgttaagagattatcagccgtatctttgctgactcattgatactgtggtgcctaagacatcttggcttttgtgacagaatcctgcatacaactttctccaggatagttcctccaggagggacccctctgccaggcactgtggcagtcacatgtccaggctgcatctctgccctgctcagcctcttcatccttgcattcagatctccatgtggtttagggtgcccatcagggtaaacactgccattgtctctttaattgctgtgctcttactcttctggctttcacaccttcagcttccaatcagtcaccagttcttgttattgccactctcctagtagcctgagaatccatccaacttcctccactgccatgactgctaacccagggtcaggccactgtcaacccactgtcaaccttttcttcaccctcagaatgaagtccagactccataatgcagttcagaaacccttaggactcaggcttctgctcactttcagcagcccctcagaatggtctgctcccgtcatttcagcatcgtgctcagttttagtccctcaactgaccgttcttcttttttttttttaaagaaaacaatttttatttaaaaatttattttataagaagtattggcatgaatacatagataaggcatttgaaatggcttctctggttggactgttgaccagctgaattccagctctgtcctgcagctgatcacccttctttctcggcgtgcccaatgctcttacctctatctagaatactctttccagctccgtggtgaggttttgtttgttttgtttttattctctttgcaataaagaattattggtattccactaaaaaataaatgtggctttgtagaaatcagtgctgtactgtgaattctgccgagctctggtttaacaagttcctcgatatctgagttagatttgctacttttaagcctttttagtttttttctctatcattgtacatgtagtcaggtctttctgaacgacagtgttcacaaagagatgtttgtaaagcacacattattgtaaagtgaatcagattttcttattttgtgttaaaagctcagagatgtggtctcagggaaaaaatgttgctgccaacctacatattactgtccttgagaataatccgagaccttcacaggtcagacaacagatgtgctcagatacttcaagcagagagcttgatgacgatgtaagcatcacaagatttatgtcagctgctggacctccacagacagggtcccagcaagctgacaggttgtaggtgagcaagcacgttagatgtgcaggtcactcacatccctttttgtgggatcaatggatgttctttcctgagaaatgaaagggcagatgagtaagcatgctagagcatgtgtcttcagtcctgctgtcactcctgaggagatgtccatgccttcaagaaacactcagagctgccagccaggcaccaaggtgctggggacacagcaggagggaagtctccatcacttgcctgtggaggagcttacctgatgacagacagtgcaggcccccgtccactgtgagtcggggaggcatcaggaggcttttttgggaaatgtgaggtggagcaccaagccaagtcccgataaacgtggaggaatgaaccaggtgaaaggaacttgcaaggaggttttgtggcctaggggtgggtggagaacacacaggcccagaaatcagcagtcttaggatggcatggaggactgcaagtgtagttcaggtaactcggccagagtggaggcagggtccagggaccaagctgggacacgatttctggctctggccagagagagagccacgcagagctctctgcctcgtattgcccccactggccaatccttgaatctcagcgcttaggacaaaataaaaaagcctttgtaatttgacaggtaaccacagagtgttaggaagtgggtcaggaggccccaagaaggatttacatcagagctgggacaagacagtctggggtcacaaatctgggagctgtggcttttgtacttcagtagctccatgtagtttcagaggttcacagattgggaagtgttctcatggcaaaatgaattccatccactgtggtcctgaatgtggttttggaactacatgtttccatttcagagaccatgcactgtagtgattaagaacctgggccttgctgggtgccgtggctcacgcccgtaatcccagtactttgggaggctgaggcgggtggatcacctgaagtcaggagttcgagaccagccaggccaacatggtgaaaccccgtctctactaaaaatacaaaaattagccgggcttggtggtgtgtgcctgtaatcccagcttcttgggaggctgaggcaggagaatcacttgaaactggaaggcagaggttgcagtgagctgagatcgcgccactgctctccagcctgggtgacatgacgaaaactccatctcaaaaaaaaaaaagaacctgggccctaggaattagacctgttagctacttggaccccagggaagtcacttctctgaaccttgaatttcttgtctctaaaatggggtcgttggtggtataatgaagcaccattcttgatccagaaaagtattcagttaatactaactgtagataatactcttgcaagtaactgtctatgctcactacttaaacctttaaccttttagaatgaggttaagagcctcccccaaggttgctgtgctacttatcactaggttagcaaaggcggtttgtgtagataatacatcatcttgataacaatacattttcccctgttattttgaaatgatttactagaaaaatagaaaatggcaactttcaaaattctgtgatatgggataaagcatctcctcagggttcttatctctgtgacctaatgcaggtttcttggtcttcttttctcatctgtgaaaagaaaaggttggtttacataatctctcagttccattcaagctctagcaactctccaaaaatttaacttggaaattacttcttgtggctaaatttagctgtaattattgaaacaacaattagttttttgaacttagaaactcttggaattttaaacctgggtaacaactataaagagaaatgcaaatgaaaagcaacaaaagcttagaaaaaagaaatcatgtttgtcaagcaacattaagtgatgagaaaatctgttttttaaaaagcgtaataactgctaggagaatattattttgcaaattggagaaaataaattaggtcaaagtcattagcatgtttgtgtttagcaaatactaccttagggggcagtttttaaagtaactttaattttttgacaactttgctattaaaagctatctttttcttcttaatgttaattgtataaagaagggacatttttggatataacctctaaaaaagcttcttctttgacttcttcttgtgtttatttataaagacctttttgtaaataaacatgtatgcatcttttttttttaagttaaaaatgcatcgcttggtaacaatcatattgcttcctaattgtgaaaatttacatttaattatattttgggggttttttcatgtaatttggatagagttgacagctactagaaaatgcaactgcatttcactattctattattttgggctcaagttctaaaaaattatgactttcaaatagacttggaataagactgtttaactgatttaatcattgtaattgcaccaacttgaatcgtattcacagaaaccaccttgcctattgctgtttttcttctttttttttttttcctcttttttctgagacagggtctcactccttcacccaggctgaagtgcagtgacatgatcatgactcactgcagcgtcaaccttagcgggctcagtgtatcctttcacttcagcctcctgcgtagctgggaccacaggtgcatgccactgtgcccggcaaatttttttttttttttttttgtagtgacagagtttcgccatgttgcctaagccggtctccaactcctgggctcaagcagtccacccgccttggcctcccagaatgccaggcttacaggtgtgagccaccatgccgagcccgcattgctgttttttatacactgaactgaaactgttcataattcattgcagagcacacggacattcagcagtaattattttttgtcttggattcctggtagtaaagaatgcttgatccttcctgcttctgccccaacccatgctagttcttactgttgtgatcagttattagatatttatttggggcacttactctgtgctgctagcacgtgatttccagataaggctgtgatcaggaatagagcaaagtcttgaatcttggtcacctcagcaccattctctaggtagttgtgactgatggtgataactggctgtaggttttgttaccagtaaataaggcagctaagctgtcatctgcacaatgcaaactgaaatcatcctgcagttttttaagtggatagtaggacattccctccattgcaagatgatttgctaggagagttttaaatagtgctgaagacacacgagaacaaagccttccctttttgagctcaggtccaaaaaagcagttttggcattaaagagaaaaggtttatgctcaagaacttcttgctttttcttctccctcttacttcttggactaagtgttggtgataagatacaaaaccgttggtgtctgaagtacctctgaatccagcagccttctaaagaaatgttatcagaattatattgtgtaatataatgctttcttcttgttgaggatgccccagaataccgatagatgtcacagattttgcagattataattgtgaatttaaaatttaaaatgtcatatattttaattactaaaaacaaattagtagacatttcttatctgagtagaagatactgttggccataacctaatccaaaatgaaattttttttccccaagttccgtctctgtttcttgttttactttccctctctctttcttaaacacatacatatactacctaccccacccccatgcatatacaggtctttctaaattactgccttttcactccacatgaccaagttgttttgggacttggtgttccaggttcagtaagcctcttacactgggttctgtgctatagaaaagttgctatagtgctggtacacacacattttcctgtaaatttctcagttctttatttaaaaataaatattttataaatcatttattgagcattgatagggtttgtgtgtgtaatcagatgctgtccttctgctttatactttggattacctgtactgtactttttacacctagtctgacttcctgtccttatactattgggttacttctgccccagctgtatcattttgtgtgtatttagagcacatgagctaaatcttatattggttaaagagtttaaaaatctgtcacaaaattttgcccaaagacagaaaattttatgttgtcatttactgttttttttttaaatacctagtctaggattgattttttttttttgtaatgcactatgagagattgcctacattaaaagcattggtaacagcacgtaaatgttttgtaagaagtttctgcgtaaggaatataatatatttaaaatgttaattcattcccatatgcttaagtagtcatgtgtgtcagatcttttcaagtacagtgttcttgcattaaaatagcctagaaattttatttctgcattccagttctgtcttctataacttttttttaacccgtgaaaatgggataaaatgttgggttttttttttttttttttaggatcatgtgtgtgaatttgaggttcagagactgcagtcactgcagagacctgaaagccattactgtctgtcctctgtgattatatgtgtcccctgtgattcccacctgcaggattaggaatgggagggagagcagggggtagaaaagggaaggtggcagaatccatcgcaaaccagtgaactccaaaacctaatcaggcttctttctaggcagattctatgagagacgaagacagaccacaaaaaacctagccctaatttttttttaacccatgatttctaatgtttatctatttgttcattttgtaattcgagtttaatcagaccaactatcaggcaggcatttagtttgcactttcaaaaattgaaacttacacatttattaaatgatatccagaatcatttcctttttcttttagaacattaaacattaatccttttgagtattctcatgtatttcaaggtacttatgattgcttatgtaggactaatgcaaaaattaaatgaattccatgagaattcttttttgacctcacaagagttaaggagacctactttatgtgaaagtgagatttttatagataatactttgaaaacctaaattactctgatactaaacagtttactgtgtctgttaaagtaaaaaacctaattgaattgcagttgaaattcaagagtctagacattccttgtgggcatatttgatttcctctttccccttttagctgttggagagggaattgccaggtgtctttagtggaaagatatttaacctgctgtctgactgcttattgtggtagatgaagtgttagcactggctcaggcttgtgagaccgttccccattactgtcctaacactttggcaggattttgagtaaagttactttatttaacctcttttgagtttgacctcatctatgaattagaaataatgatacccttcatacttagagaatttgggaagagcaaatgagatgatgaatataaaaacctaccctttcagaagggtaaaaataaaatactaggatttatggtcatagcattttagaattcggaaggacaacctcctgactctaagcagtaaaagtggcaagcaaagggggttcagccattgttgagagatttcctacttcagtacagtgctgggtctgggatccagcctcaatcatcctagttcactgtcactctcctactgtacttatctgaaatggcaataatagttaacttcctctgtgcttggtacactggatgccttatataaattgtctcatttaagtcttacatcatccttgtgaattttgattcccattttacatatgagaaatcagagactgtgagaggtgaggtatcctggcaaggtggtagcacagctagtgggtggcaaagcctgaaactgaaccttagcagtttgacttcaagcctgcgttcttaacctttatgattatctttgcatattttttttaaatcaagaggtaagtttgtttaatcagagcacaaattttattatcttggaaaaattattcatttctttgtcttagcttttattcattcttcacatagtgtattatgaagtcaaaatcatatgtagtgatgactttttaaattaaattatctatttaggtcttccaaaaatacagaaaacattagtgaagcattttaagtttttgttttgttttgtttttgttttgagacggagtctcgctctgtcaccaggctggagtgcagtggggctatctcagctcactgaaacctccacctcctgggttcaagtgattctcctgcctcagcctccctagtagctgggattacaggcatgcatcaccgcacccagataatttttgtgtttttagtagagatggggtttcaccatgttggctaggatggtcttgatctcctgaccttgtgatccgcctgcctcagcctcccaaagtgctgggattacaggcgtgagccaccatgctctgccatgatttttttgtttttatatgaagttcttctaaaataaagcaagttataaacacaaatacatttaaatttcagtgtttttacaaggccagggaagagacgcggcttcagggaaaaatatggttgaactttgttaatacatacatttttttgccagcaaaattggagatatgcttggtgtgcacatacattaaaagcagtaattgttaacacttttggagtacttcacagagtgcctgcccagactgtctgacatgcttctcatttggtgcctacgcagccttgcacagtagtaaggggagagtgaacactcatgacctcctgctgtctatgcacacactccctcccccacagtgcctcagctcacacctgagtatctctctgcatgctcccagggagcttcctgcagtaccttaggcattctgaaacgtgtgtctttacaacaagacacacttgttaaagctgtttacaaatgagccttggcgggggcggggaaagctggttttcatttccagttattttaaatttaggcttatttcacacttcagcattcttttaattaatgtgttttaattaaaagaattaattattcttggttggtaatgccctttaatttgagtaaagatgatatctaaggccagcatctagtattaagttatgcctagatggacttctgttcatttattctgttactggtggttgttctttactagtgaaataagttaacgaatgcctgcctgtcacatgtggggcctttattttgtgttcagcaggcaccttctttgataattataagagcttagtgactgagagaattcagtaatcttcctgacccctatgccttcccaacaaaggagattatcttttagtttatagaaaggtcactcaggtaaaactgaaatctccttcaaggcaagataaatatctttatccttaactgtgtctctgacatgccattattttttcttcagtagtagtttgctggcccataagtcttttatgtgaactgcttatggttggaaacttaaacactgtcactttagctcagcacttgtttattgacatactttcctatgtgtatgtactgtgctaggaactgagtgagccctaggtaaatgctggagccaggggagataaaaagagagtttaattcttgtgttctctagctagttattgattacttgtagctaatttcataagaaactcttggaggaaactgaagagtagttgtaggttctacctggatgtgacaggattctatgtgtatgcctggatatgaggacagcttgttgaatactgcctgttaatttgcttttgggtggatcatgaggtcaggagttcgagaccagcctggccaacatggtaaaaccccgtctgtactgtacaaaaaattagctgggcatggtggcaggtgcctgtaatcccagctactcgggaagctgaggcaggataatcacttgaacccgagaggcggatgttgcagtgagctgagatgatgccactgcactccagcctgggcaacagagcaagactccatctcaaaacaaagaaagaaaaaagatgagagaaatattgttgtgctttaagaaagccttttaaattaaaatgtgagttgacaccccagccagaataagggtgatggtgtcaggctcctgaaaatgattttgttgtgtatattttacttatatacagcttttaagagaataacttgtataaaataagatacttaattttagatattattataataagtcttaacaagtaataagatataaaattaagtatcttattttatacaagttaattacttattagtggtaattccacctgcaggcttgaagtttcatggcctccagtgtttctctccaatggaacctttgctccgttgaaccttggatggcttagaatctggcacagatgctaagggttgagaagtgaatgatagttctgttggcaatcttaattccttgatgggcaggcccaggatcacatccataccttagaaagggtagcagggaaatactagctcagcttcctccctgaagaatgccagtatttcctggaaaagagctgaagaggatcctatggaggagcctgagaccactgcaggttaggagacaggaaggcagggaagaggagacaggaaggcagggaagaggagacaaggaggcagggaagagttgacaggaaggcagggaagaggagacaggaaggcagggaagaggagacaaggaggcagggaagagttgacaggaaggcagggaagaggagacaggaaggcagggaagaggagacaggaaggtaggaagaggactttttccaaggagccagtggtccgcagtagggatgctgctggttgagggctacagaggacgtgggttaatggagtgatgggagtgggacgtactttactgagggatgaaggagaggtgcggaatcttaggctactctggagaaacctggagaaggagggagatgggagagaaatagaagctagaatgtttgcaaagatgaagcattttggggtttggtggttttttgttttaagataaaaagggggggaattttacaagctgaagagatggcacagagaggaaaaagttttatttgtggttaaagtagtgagcatgcttttctgaaatgtcatttctcaaggagatggcggcttggagggggtcaattgatggttaataggaagccagtctaatgaaaagctagctatacctttgaaataggaaatttgtagttagaaatgtttgtgttctctttgtttaaattgtagcttgtggtataacaaaacattcactcatcaaattttgtaaagaattggctgtatgcagatactaggaagatggcagtaatgaaacagacacaaatccctgctctcagagagataatattctaacaaaaacgtgtttgtaagtgtgcgcagaacccatttcatgatttctgcttggtttgtggactcgactgaggttgatgtgagcagttcctgtaaaggaccatccctatcccaggttgttcagagaattgttttccgtccaagccctctgagtggctcttgtgtttgtctaccctcttcctaattgtcgcttttaaatacctcatagaaatactctctctccatatttcaacttggtcagcatgtgtacctgactacagccagtcaaattttggtgctggtgacatgggtgtggcagtgcacgtgggaaggtaattcaggaattaccttttttttggtaataatgtcagagtgttaaagtgattagtttttagagagttaatttcggacctatttagaaatacccatatagatattacttattctcttgcatactgataggctttcttggatggggaaagtggtagagatgtgattaacgctttgggcatttgtgcggtttatcttgtctctgcttcgggtcgggagtgacttgttactgtttacatgaggctagttgtgtggcactccctaaacagtttattgaagttttgtcttgtgtatgtgactgtcatattatgatggcagagttgttgagaacagctgcttcagcctattgtcaaacattttggccctatccatccagcatacttcttttaggggactgaaggaaagggacccaggagtgtctgtgcagactgtcatcctagtaatgcttacttggaacagtgaacacaatcgattcaagtctcaagtcttttgatttaccttaatccatttgaattttgtattttagccacctttgtatctttgacataaaaccatcacagggtactcctctcagaaatcttggaataaaattgacactctagaaaacagatgctccattttttatgcttatgctgtggttttaaatgtatcctgccagcagtatccccccaccttaagctaggagaatctaggtgtgagaaatttggattcggaattccagcactgccccccagacatgcccattcactgaccccctgagctagttccctttcttcctcttgggttgcttccctaataggatgcacttcatggcttttgcatctcccctcccagccacaagatctttgaatctctgagggttttcttcaaggcattttattcctacttaccacaggaaaaattaacagccattaacaaaattatagacatgggtaagttcctaagttaggttttcactgaaatatatatgagtctagactcatggttcttagcttctttactgaccatctcttagtcttttcctggggttgaaagctgtcatttttcccaagagtggtgtgggagctcttccctctttctgcagtgccccaggactaacagtggatacttggcatacacaaaggcctcagtgaagcttatttacatcttggagatctttctggcgtagaagttcatattggaaaggcattgcttcctcacagcttcctatgtacaaatactgggcatttgggagtctggatgaaagatgagtaagacaaaggctttgttctcaagtaaaagtccaaggggaaaagattaatccattattttattaagtacatatttattgactaccacccttgtgccaggctttctgctggggcaggagacataagcttgagacccatttccgtcctcacggatctcaaagtcaagagtgggaaacagataagaggccattatagcagtgctctttgctgagtgaggactgaggaagatttcttcacactgagttttaggggacgtggccagtgggggaggctgaaggcagcacctgggatggtttctccaaggggaccctagagcttcagttaatgaggtgaaccctacagagtactgacaccaggaaatatgcctaaggaaaactagataaactagggttttatttttattttttgcttcttctgtatgctaggcaaactcacattttattagctgtcagtctgttttcatttttcagtttaaaagttttcaggttgataactttggtccggtatcagtcagagtgatgatgaattgagtcaaagctgttgttttaaaaagaatattcatatgcatgcctatgaaaaagagctgtcttgttttaaaatggagtaatacaatttgtgttacaagtacagttctttgccccatttccattcaaattgtcatttatatctgaaatcattaaaattagaaaacagttatgatgaatgtcttttgaagcatatagcaggaaaagtcataagtcaaaacctgccagtttaaagtaaatgcaattatttggttctatgaaattgtagcttttgctatagtgaaaagaaattggcatatttatgaacaactccaggatctcattgaaatgaggaagacattatttaggaagacagtaatgattcagactatatttaggacaggatgttagagttaatgtgccttctctttcaagtgattagtgggcagatgacatctttggtattaatgattgcctgagttaacatttttaaggaaagagtgccacctactgaatgaagagcttttgttttcttccattcaattcgaagaatcttgtttcactttgaatccttagtgggtggcatttgctgggcagtgatcccgtcttccagtggattgactagggtagctaggattcttagagggagtttatgcccccaaaaccaggtgtagaaacaaaacctaagcataaacatgattcagcacttggcaagtctcaaaaccttaccatcatgttaatgtactcactggcccagaaggttttttgttttgttttgttttgagctaggagcaaatggctgggaggaaatgaactattccaaaaaataattgaaggggattgaagagcatatgacattggtcgagatcttctggggagacttcgttttcctagggaataatattagtgcagagattgcttgatcacaacttggccataggtcagtggagggattcctgaggtcaagttgcgaatccaaaggcctacttcagagtaatccatatggtgctctttttgtagttcctaacaatagtatctcattagtgaaaggttgagtacatgaacagcagcaaacacaccagtatccgaattaaaggacatcatttgagaatttcgcatagtcattatttttagtatattgggacatttttgatgttgtggcttaattgactactaggcatcagccatctccagctttttccacttgtcgattggattatgcaagtcatgagtggtatttaaaagaggtggactgtatgctaaattgatttatccttgcttatgtgtacagattaatggtataatccatgaggggtgatagattaagatcctgaagtgaaaaaatacatatatagtgtcaggtatattaaccaatggttagttgccttttatttttccagtgtaaagtatagcagatccttcaataatgtcatttagttgaacattttggacaattttgctaaaaagttgatgaggataaaaatctcttctggcagaggctactgtctgtatggagtttgcatactccccccatctctgggtggattttctctcagtactctggtttccccctgacaccccaaagatgtgcacgttaggttcattgtcatgtctgcaaggacccagactgagagaatgtgggtgtttgttaatgcaccctgcaacgggatgacatcctacccagggctagttcaagtctggcaccctgaattgttgggacaggctctggccacctgtgaccctgaactggaataagtgggtaaataatcatcttattaatgtttcttaaatgtatgttacagctcacattttttcagtgtttagtgttagaagtgtttggggtctctagaagtttggtgatgtttttgtgaccagaaatatgccatagaaactttcccacttgtttacatcaattggcctatggtaaagttggttttaaagtcaaagtttctcttattgtgtaacttgccattgacatctactcatgttacttaaataagcgttttgtttgtttgtttgttttttgtttttttgagatggagccttgctctgtcacccaggccggagtacagtgccctgatctcggctcactgcaacctccgcctcccaagttcaaacgattctcctgcctcagcctcccagttagccgggattacaggcacatgccaccacacctggctaatttttgtatttttagtagaggcagggtttcaccatgttggccaggctggtcttgaactccagacttgaggtgttctacccgcctcggcctcctaaagtgctgggattacaggcatgagccactgcgtccagccaaataatgagtattaattggctgaatagcaagtattctctgaaaacattatttaataatacaaaacttgtaaatattttagcaataactgtgttttcagatttgcactcagaaaactagtatgacttttaatattgtatcccagcttttctccttttaaaaaacagaaaaccctaacttctgtaacttgactgagattaagcgtatctgataccattattccagattatgagaaaagtcagctgtgtggctacagagagctctggcctgaagtagttattaatagaattcacattgggacgtaaaaacaactggaactgaaacttggtctgagagccgccatgtttcatgtctcatttcaggctactactttgcatctttttgacttacagcacttaaatatgcaaatgcaaaattgttaaggttttttttttttttttttaaagatggagtcttgttctgtctgtcacccaggctggagtgcagtggcacgttctcagctcactgtaacctccgcttcccgagttcaagcgattctcctgcctcagcctcctgagtagctgggattacaggcatgcaccaccacgcccagctaatttgtgtgtgtgtttagtagagatggggttttgccatattggctgggcaaggtgtttcacacctgtaatcccagccctttgggaggccaaggcaggcagatcatctgaggtcaaaattgttaagccttttaaggaagagaaatgtatggcttattgatttaaaaaaaaaaaaaactagacaggttaatatttttcatgtaaaacgatcttaaaatctttgtgctctctactttctcgaatgttctgcttgacagttgtctgaactttctgagagctttgatagagtcttatacataatacgtgcctctcttagtaataaagtttgaattgctatgatagtgaatattggaggagtctaaaagttcgtaacagtatgtcacccatactgatatactgcctgagttagtacaaggggtctgcagatccacttagctaccacgtagatggtgatgataccttaagaaaggattttcacattcaaaaacatggagagccactggattatagaatgacaaagaatattttactcaaaaaaattttgggaagtactctccagatttaacgattaaaaggaatttgtggtcctattgagctttctatcttctgatggtgtctatctgcctgacaggaataatattgatgtggcagtggcgataaatgaattgtatgttcacactgaatgaccctaagctatcatcttgtagtctgatgtgatttcataggttcttaagttccaaaaaggttgtgaatttcttaagagcatgtcatggctaatggcacagtcaggacttgattatgaatttccagacccctgaatcctgtcattttcctttagttccgtgaagcttcccacagtgtggagtagtagttcagtggtgcatgtttatttttaaggaaatatttcaagcatacagaaagatacagatggaatacattagataatagtataataaacagccagaaaaccttcacctgtatttaataaatgttaatattttattgtacttgctgcagtgcagttggatgtgtattttttaaaggaactaatattaaacagttgaagcctcctttgtcttctggctagagcttcttctctccctcaataccagcagaagcagccttgtacagcagtcttcatattctagatgttgctagtcaacattgttaccttctgaaaccagaaaaaaagttttattttgctactgtcatctgtttttcaaataacttgttaaaagaagttataataacagcatagtggaggaggacaggactttaaagtcgtagagagctggttttgaaactcagaattgtcactgactatggagagttaatcaaactacttaatctttctgcaggtttcttcatctgcccaatgaagatgaggactcttaccttgtagctttggtgagatgtaaagccactgtatggacaatacctagagtagtacttagaacagaggaggcactgcagaggctagctttaatagtagtagtagtgatagtagtaattcagtttattgtgggctaccatgcacttggtgccattgcaagtacttcatccatgttcatttaaaaagtgaggtaagaattaactatatgtaaaagacttagaacaaggtgtggcgggtagtaggtgggtcataagtattagctattattattatccccatttataggagaataatgggaggaactctaagaagttaactttcttctaagtactttacatatatattaatttatttaatcctggtcgctactttatatggtagatactattatccccattttatagtgaggaaattgaggcacaaagaagcacttctaccaagattgcacaggtagtgtcagagcttatatcttaacccaggcagtctcgctccagaactcatgcccctgatcgctgtgccatacttcttctgtatgtggtatggcttcttaccttatctatccagtcctaggaacatatctttcaggtggtatgatctctattgactaagaagtccttcctggttttgttgtagatgcaacacgtttcctcatgtgaccccagcctgttaaaatggggtcattttgatagaagctacctggatttgattcgtttgggtggctgttgctccataagtacctttaacagtctcttcaccccccacccaccagttcttcctgaagtccccagtgtgggtcttacatgtgctgaatttggccagtgacccagtagccgtctctggtcagcactgctttctggccattgccatcacctccttcagccacattggcctcgccccctcggacctgcttcacccaccagtcctgccagtaacaccaccatcagtgctgaagatgcacaatgttcccactgtgcagagttccagggtctttacaatgaaatgagaaccattccccaggcccatttattttattttgtattctgggacttacttgtaaccatatagagacctttagagaaaataaattaccaaggttttttggtttggtttggtttggtttctcatggcttttttgctttcaccccagacctaagagcttggcagagaatgagtggactggaccaggggcaaatctttgtgacagactctggcctctgctagtggttggattgggccaggcttgaatttctgatgcccccttctcttagggtgggttcatacaacgagactacccatctcgctggctgtctaaataatcttttctccccatattcattttgaattattggagccttaattgcactacagacatgctaaattttgtgatagcttaagtagtattaagacattaagattcctggtgttagttttttctctgcaattttcttagaaatattgacttactggagccagagggtctgtagagatgagccagtacaggtttcttagagtatgttccaaggaacactgcgctatcaaagatgctctgcataaaaggacttccatggcaagtgaatgtgaggaatgctacataccttctttttccccttggagattaatgacacatgtaggtcttattagaggctctgtgctgtcctgtgataaataaagccaactaacttgtttttatcaagtgttccctgatttgcagaatcattagatgtttagtattataggattgttttttttggttttttttttttttttttttttttgagacagagtctcgctctgtcgcccaggctggagggatctcagctcactgcaagctccgcctcctgggttcatgccattctccagcctcagcctcccgagtagctgggactacaggtgcccgccaccatgcccggctatttttttgtatttttagtagagacggggtttcaccgtgttagccaggatggtctcgatctcctgacctcgtgatccgcccgccttggcctcccaaagtgctgggattacaggtgtgagccaccgtgcccggcctaggatattattttgccaaagctatgtcttctgtttggaacatcttttggccttcaccaactctctcttccagttctgttctttaaaattattcaggcatcacctcctctgtggatcttttcaggactctcctagataaaattaaggatggagatcactccaccttcgcaactgtttatgggatgttaaatacttttattacagcagagttgacattgtgttttcttgcttctgtgagacagaatgattggaggaacacagaccctgttttatttatctttcgttttttaatttttcttctttgctgcctggccagtgcttatctgtggtaggtgtgccagcattcattgaacggagtggtttgctagcattcaaagcataaagaagaaaagctgcatttgtcaggaagtcattcttcctcattctgagcatcccagttaacatgcctttttaccaggtggaaggaaatagtatagtactagctgttctgtagaattttgaaagaaatccttctcctagcaaagactgtaagagggctttgtatgctaattcggggttatcccctcttctcctttaatctcagagcattaaaaacagttaagggcttttttaaaatagaaggtattcactcaaaatattacatatctataacttcttaaaatacagaagctttaaattttgttagtggggtaagaattatagtaagttgtattatgccataacctacatatactaacagaccactttcgtaagtatgtactagccctgttgagttgaccacttagaagtatactcaaactgcactgccacatttccccaaaggtaacaagtaaacataggagaaaacatacactgcagccttcatgtaacactgacttgggatctttttaatgaacacccaaatggtgaaggaacagaggttttcatttcactgtgccatgcattctgtaccagtgcccccagataagggcaggatgcatggccttgctgagaacacccctccccccacagtagtagtgtaggaagttccaacctacttctctagtgtaacgtctctctaggtttatgcatcagttgtcttgtagacattcccagccctagatttgtcaagtagcaaggggggattcttaaaaggaaaaacacgtttagccaaaaactgttttgttttgtttttaaaaacatccttcttacttactgatctgtgttcaacaattagggaagaggatactcacaatgtttcatttttccccaaaggtttctaaaggtttttcctcaagtaccaaggacacaacaaaggaaagaataaacagtggaatttttagcgcagaatgtcaaaagaatacaaggttttatgggtttttgttggaaaggaacaagtgggaaatgggaccatattaattttaaactccctctgttgggtgctcagaacatagtttaccttaagcctgatggatgttctgagtttctccccgcagggagataggtgaaagagtcctagtatttagaagtactgttacaaagctgattactctgatgagtgatataagtgttttaaagcaatatttagtctaagtagtaaatattcctaagacagacagtaactttacaattcatttgttttgttgtcttaaatggcagaacaatgttgtttttctgtcactaacgtttttatatgttttctaagatgatgaatcatacagaatcaccaaactcatatttctgttcaggtctgaccatttttacaattttcatttgcctatgtaaatattacccacatattatagttcataatttgtgatatgtcagcagatttcattgaacttgagtcttaggtcacaatagaactaacaacatattggcttcattctagtccaatttgttttcttttatgcctacacaccaagggtgttcgcttgaaaacaagtcttccttcacctcctgctttttctcctcacctgctctttaaaaaataattgtacctgactcaaattgatagtcttctaggattttcattcgctaactcaaattgctagtcttctagagttttcatttgctaccaagttaacttgcttactaacttgatttgtcttatctcttttagatttatttaaaatccctaccaattttaagagtcactgcatattcttgattacttctgcatggctatatctccatgtccccctctccgaattctgatgtgtatttgacttgtttggattatatttcctcctggcaagttttgacttcgttgcagtttgacgttttcttgacctgtcagtgctcatgattgtttccgtggcttaacaaagtgtacatatttagtttcattattgtataaatttgttgatttttctgttcatctattaacacatttagaagaaagaacttttctttttccaaatttgaacagaacatctcaattctattagtgatgtgcttagtaatgtgtattggattgatttattgtggtacattaataacttgaatgtggtagtttttaatggaatctgccagctacatttctgagagacatgagtgtgccaaagaaacaccataaccaagcttttacactactgccttattttctttctggaactaggcaggtgtaaagagatgatttagaaaacctttttgcattttatctttttcttagtgtttatctgggtttcagctgcaaggaatatagcccctttcgtttgatgatgtttatccatatttaaacatggccacctgaaagtttagccttagtgttttatcttaaatatgtcagtgactttggagactgttgaagtacatccataatgtttgtatgttagtttaaaagtaaaaaagacttggtcgggcgtggtggctcatgcctgtaatcccagtacttcgggaggccgaagtgggtggatcacttgaggtcaggagtttgagaccagcctggccaacatggtgaaaccccatctctactaaaaatacaaaaattagctgggcgttgtgttgggcgtctgtaatcccagctactagggaggcgaggctgcagaattgcttgaacctgggaggtggaggctgcagtgagctgagatcctgccactgtactccagcctgggtgacagagtaacactggatctcaacaaaaaaagtaacacttttcctgcaaggcagttttctcaaattcatatttgaatattcttatgactatttgtggtcaagaaagatgccttttaatcataaaataatcttgaatagagtttttaaaaaatgtacttcatgcaagaagacaaatgagaatcttttccttcacttaataatgtattctctgctcataataatgccctggtctacagttgtcagtattttatgcagacgttattttatatgttccagtggtgtctgaaatttatagcacactgagtttgagttaccagtaataatttacttagaaatcccttcaagtttattcagtattcaatagaggatcagttgctttaaatatattcatacattttgagcatgtaagaacatttagtataggagaactgtacagttaatatacatttttctttttgattcacttttcttctctaaagggagatttgggcatgtactttatagactgagtcaaaggtaattgactgcaaaaaaaaaattgatacagagttgccacttttaagaatgatttgatactgactagtagctctctgtcttttgtaaattccctcttattatagttagttgcctgatgattgttacaaatttactaatttggaagtaataaaaactttcgaatattcttccttttctcattgaagttctttaccttttctctttgaagttacttacatatccctagaggcactagtttatggtagaagttgttaagggctatgtttgtccatcatgaatgatggtgtaacatctgcatggtgttacttcttagatctttgttgattagaagtgataatcagctactctgactctgaatcagggagtgtttatcaagcccatgacatctgttgttctgggtgctttgttcctagctgcaggacaaggaaaaggccctgccctcaaagaatttaccctttccttgtctagttcagccagtgattgtgtgtttacagtatgattatctattaatacattgtcttattttaattttggttaattttatatatattttatgtttctatactgtgttctggttttcaaaatcctgtaattgtgctggagaatacttttaattttaaaactcaaatggagtggtgttttgatggaaactaatccatgatttagggtaaatggagttattgtgcatgaccatgtggaatatgttatcaatatgagtcaatcagaatcactaaggtggtattaaactgcttatatgtcttgtttataattagttgtgttattgtctttgttacttgacttccatattacttaactgttgatgtggttaatcagaacatgagctttttgagggtgaattctatgcccatatctctcaaaggcctaaataggaatgtttgcacacaatacttaaaatagtttttccactaataaagatttctgatacagattcaacatactataaaactgatttcaaccgggtgcagtggctcatgcctgtaattctagcactttgggaggccagggcgggcagagtgctttgagctcaggagttcaaggccagcccggacaacatggagaaaccccatctgtacaaaaagtacaaaaaaatgagtcaggtatggtggcttgtgcctgtggtcccagctactcgggaggctgacgctggaggattgcttgaattgggaagtggaggttgcagtgagccaagattgcgccactgcactccagcctgggcgtcagagccaaaccctctctgtctttaaaaaaaaaaaaaaaaagaatcaatcctttgttgtgctaaagagaggatatttaccctatggggggataaaagtagtagtgcctgtttcttgttataaataaatagcagttgtgccgtctttagtcctcagggtcaaactttactgaataaaatctggaataaaatcttgtgggaactaattttcagaatgtgagccatttttatacattgttacttcttatgtaaacctacctatgttataaatgttgtatcatataaagatggaagattcgcccttccaatggtttatttaatcttccttgcttagaaggaataggccaacagttggcaaagacagtatgtctctggagaaactatcttactggaaaatagaattgtcctagtattgagataaagatggtttggttttggttttggttttgtttgcagatgcctcagatctaggtcaacagattaaaagtacttgtaaatattcattttccttttgttcttggaagacacagactgtgaaatcactctcatctgagtgtaagtcatagtgttttttacatatagactttatcaccttgaacatgtaactgaacctcccatatcctttgtctcatctgtaaaatggagtagtaagagccgcgtctcaagagaattgactgagtaacccatgtgactgttagccctatccttgggaaggaattgtcagcctttctgtttcattatgctctccctatcctcagtttaagtcattcctgctcttgtcctttacctggaaccttacactttaagtgtcccacaatggactaggattgttttggaaggtcgttcctcccttgctgtcctcttcctcagtaatatggcttatgagtttggtagtgtgtgaatttcttctgctaggaaggcttcacaggtggaccttaattagttagctctgaattgtgcctatcccaaataatgtattttctagggttccttgaagttccttggacaccaagagaatcaagatacggaaatcttaatttatacctaaggttaaatctcattaatttccagaaaggttttctacgatcgttatagtcttagttgcctctattgcagtgaaatgctctaataatgaagagaattaatatgcttctttaattattataattaatcaaatcgtcactgttgtaaaaacttacaaaacttgtttggattattatcaaataggtatcagcacaggtgctgacttcttgtaaaaacaaacttagactgggcagtgaacactcatagcagcagagagtacagctcttgaatcaaacctgtgggggtttgaatctggccctgccactcacttacaaactgtgttaccctgggcataacccagcctccccaagcctccgatggaaaagacctcacagggttgctggaagggtgcagtaaattcatacatgtaaagcacctaatccattgtctggcatgtaatataatttttctgtgatgacactctggcagttatttctccatatcgctggttgttgacaaacataatatttccttcctaaggatgagccatttaataaataacttaaaaattacagtagactggtaggattctttttgtttgtttatttttttggacatggagttttgctcttgttgcccaggctggagtgcaatggcgcaatctcagctcaccgcaacctcagcctcctgggttcaagtgattctcctgcctcaacttccctactagctgggattacaggcatgcgccactatgcccggctaattttgtatttttagtagagatggggtttctccatgttggtcaggctggtctcgaactcccaacctcagttgatctgcctgcctcggcctctcaaagtgctgggattacaggcatgagccaccgtgcccggccaggattctatttttgagtgtttatgaaatgtcccctgtgtgccaggcattgtgcagaactagtgttttagtcagactatttgaggttgcagggaacagagatgggttaaaatttatttcattccaaattaaagaatccaccaagaagtttcctccattgcagcatgtacacttggcccgtggagaactagtcattcattatccaggggtggtataaaagtggctgtcatcatctaacagcttatcaggggacccgtgtacaacttgttaggttgacttttgttgcttctgcatccctgtctttcttctaatttctctctcttctcccttatttctgtctcagtgtttctacttattaccttgctctgtttccgtgttaagtgccactcttcctgcagtaacactatttgtgtgttttactttcaaactctcagggagagagctgactcaggcgtacaataccgttcagtacagaaggtcattggaccaaggaacattcctggaccaggcagctgtggaagctgggatggattcagatgtataaagcaccttaagcattagccaccacccttaggactgggcagacccttcgcttcccagaaaggggcagtatgtcaggtcactgggcagtgtgatagaacaatgaataagagggaacttgtcctggaagagctcacaatgtggagagggaagcagatacttaaacatatacttaattttatgatatattgtagttaatatttaccatgcagcgggagagcagctaactgccgtagaatggtggtaggaaattcttcattgaagccatattgagatggcaaagggtattcctggcagggaaaaaaaaaaaaaagtcatctgcagagacgggagtaaaatatcatggtatatttatgaagtttttttgtgctatgagaagagggccatagttggtatttaaggggctccaggaagaaggtctaatttatggtactgatgaagatgattagacatagaaccaggagaaaaagacctcatagaagagtagaggagagacctacaagagagttagcacaatcaacagtggctgacaccacattataaggggaggactgactacagtttccctgagaagggacccttgaagcatcttggtttttaacaggtgagttttgtaggtctaggaagagtctagcactagaaacctaacctcagggagtaagcgttcttgaagttctgtgtcaggtcacaaattcattcttaggaatgtctagaaaccaaaaccaagaaacctcatgtttcctaaataaacaggaaatgaagataaagcttgatctgtaatagtgcttaagtttctcttatttttctgaccacaattttatttatttttaagtcttcaaggtagtttctcaaaacacattgtttagctgaaatctgttatttttttaaggtcaaaagtgtatacactattatttaaaataggtatgtttctgggtaatgtttggcaaaaataactccccgaaacattcacgtttaaccaacatgagttggagatggctctcatctcccagtgacttcacagctatctgtttagattagctttggttaaaaaaagatttttttcctgctatggctgtgatatcttaattggatgataaatcactgctatatacatacatacatacacacacacactcatctagtaaaaatgaaaaccctatatatgcctggcttatggaagattatatgttaggattataacaaaaacaatacaagtatgtaaaaaaatttttcacagtttggttctgtttcagagagaaattaaacagagtagatgtgatttattcgtggcaaatacaataggatttactatatatttcattgattcaaagatcccagtggttgtaagttgtaccattattttatatactatgaaggaaataacacctgccagttaaattataataacttttgattgcaagaggcattcatatttcagatattaaaatgtgaaaaaatacacattttaaaattaatgacatgtaattattacaaagagactaggaaaaacactttggtttatatttgcagattaatttaggaacagtgaaaattgttctgaacaacatctaaattgcaaatttagtcttaattaaatacagaattataaaaaaagttaataagaatagtcattaaaatttaaaactgggaaggctgtaggactgccagagttaataagtgatcattcacttaatatatgttcatacttattatgagccagacatgcttagatgttaggtgtatagatggcgataacacgtggtcccctcactcatggagcttacagttcataagagaggaacagtttgcaaactgcattaaccatgttaaaggaaaaatacaagtgctgtgaaagaatggaactgggagttcttaattgaaattgggaaagtctctgaggagttgaggaaaatctagagagtgggtagaaattaggtaaaaagtagacagagaaggaagcagcctgtccagaagccctgagtaggaaagatcttggggttattgaggcagtgaagaaggggggttgcaggtctgatgacaggaattgaggtgagaccacgaggtgcagggccacttaggttgggctaaacattttggattttagtctaagcccggggggaaccactagagcattttaatggaggaagtaaccctggctgcactgtgaaatctgggtaagattcaaagttaaagaagcctcgttaggagcctgttgctagttcagagcaggtttaagagcagcttgacctggatgggcgtgtgaatggaagacatattttttagaagattatttgacaatattatcaaaagtcttcatttgtgtacatttttaacccagcatttccatttctaggtgtttattctaaagaaataatttaggccaaatgtggtgtaatcccagcactttgggaggccgaggtgggtggatcacctgaggtcaggagttcgagaccagcctgaccaacatggtgaaacctcatctctactaaaaacacaaaattagccaggcgtggtggcacatgcctgtaatactagctacttggaaggctgaggcaggagaatcacttgaacctgggaggcggaggttgccagtgagcctattgcaccattgcactccagtctgggcaacaagagctaaactccatctcaaaaaaaaaaaaaaaaaagaaagaaaaaagaaaaaaataatctcatagtccttaaacataaataaggtaaaacgaaatttaaaaaagaatctcagatgtgtgtaaaagttcagctactagaatgctcatccctattatttatgataaaagaaattggtctaaaagatgacagtattttcaaacaagtggaaaggaaagagacacattagactttaaggaggccatgccatccagaaagatttgtttagacaaggaacatcctttgtgtgtttgactcagggccaggaacagaaactgaaaatccatagcagagaagagatactcctgaaacagatttgggggaagagagatagctaggaccagaggaaagactatcaagcaccttggtctaggagtgcaggagtttctggtataaaaatgcactgcagttccactgtgaggcttattttttggaactagcctgggaaccaaaccacctcttgcaacattgttactggagggggaaagcgcttttaatactaaagacttggaagtgaatttttattatgcagtcaccacataaattcagttgcctacaaagctgagcctcctggaataccaactgagcaggatggacttttttggaagacactttatcccctgtgttcttcacccctacctctctttctctgccttcctctccctcctcctttttctcctcctcctttcttctctgccttcttcccttctctccatccccccttcctctttccttctttctcctccctccctctcttactttcttctacacatcccctaatatttatattttataatcagcataaaaagcagccaagcacatataagtaaattagataatcctccttttttcatactttttgaaagtctcatattgcttctatataacagtatttgtgtgtgtatgtgtgtgtaaggaaatattttacgctgtggtcttaatgcctatttgcaagtttcaaaccaaatgttatgtattctttgtatttctaaaaatgtctaggccagttgctgatacaaagatgtttaatatgttgccttctactttcctcacagtcttgatgcttcagtgaaacgggttaaccgtttcctttctagtgaatatttttttttaagtagtttcttcttcctttggctgattctctgaagatcgtacttcatagttgtgattagctggaaaattcctagaggagtttgaatttgtctttgtagtaaacttgaggttcttgtttttggtatttccttgagtatttccttttcctatcagtgtagaaaaactgttctctagctttaaagacttttcaaaatagttactgaaattagcttagtatttttaaagttgttactaatcccaaggtgcagttgctttaactgcatccttataaatcaggttttcaaatctatgcatatcgtgtatgcatgtatgctcatgtggatatgggtatattttaaaattagtgattttcgtgagcttgatgctttgcctgttaggctttgtagagttaattctcaaacgttcttagtttagagattgttttattctggtaaatccacaccattttatggagtaaagatcaaatgtttgtactggataatttttattctttatagagtaccccaagtgctttgttatgaagtcactgttctatgaaaataaaaatttaatcatgtaggctatgaaaaattgttttggggtcatagatgatgtagttaagtttcacttcacttattaaatatttattgagcttatttcagataaatcagcatatccaccagattctatctgtattgacttaatttattggaaatcctgggataaaagtgtagtaatacacccttctaaatatttgttatttgggtggtagaattaaaaacaatgcagtcttagtgaatatatttgttaatatagtgcttaatgtcttgggattcattttgttaactacagtggaacataggtctgcatgatatatgtcagtagtatataattcagaatcttttcaagctttaagtcatttggggtttttagcagttatcttttttattacatgtccgttggaagtataaaatagaaccatccattctgtttgttcttggaaattatttttcatatatacatttctcattttatttgtttctgcctgcattttagtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtaagtggctatgggttaccagttataaggaagaaagcataggaggaaatggaaaagtaagcataaatagatcctcttgtaagcttttcttcttcattttaaatgtagtagttttctttacttgatattgtggtcatttggaagaaaccataattaaaactgtgctcattaaacaacttaaactattctgggaacttaactgttgtgtttggtggaggggtaaatgcttaaaccaagactgccctctcatgtcagtatctaaaatcctttcattggagttttatactgtacttgtaaattttaaaaagaatttttccagtttattttagatgttttatctctaagacaggatccaaggatcttaatttcagaaatcttctaggaaagaaaacatttaattgcagtaattcataagtgtaatgattgggttttcacatgcatgcataagatgtgcgtttctccaactttgttacagtgtcagcatgttatcctcatttgacatgaaaaaatgtttaatagacctatggggattaagataaattaaaaatgtgtggggtttgatgaaagaaaatctagagtcctagattttaaaaagcagggatactctgtcctttgctataggtataagaatatatattcttataagaataccatcatgaaatgtgtgtcttcattcttacaaaggaagaagtattacagtatcctagcactaatctctctcagcaagtttttattttgttcttttaaaacagatatggcaacttaaaattcatctaagctttgacaagggtctaaatacacccctgccaagtgattgtctgccctacattcatcccatatgcctatttaagtttacatttaaattaattagatgtaaataaaagtaaaaatttagttcctcagtctcaccaactacatttcaaatgctcagtaaccacatgtggccaatggctaccttttaggcagtgcagttttagcacattttcactgcctcagaaagctctcttagatgtgtagtactgactcgtgtctgacttaaataactcaataatccctgtggctttcgatatcctcatcactgagctgcagtctgtcaggaatattttacccactggttctcattctaaccgatggaattatacagaataaatctaattgttcctttccataccagcacttggtaagttattatgggcccgtgagtccttgtctttacagctaagtttctacatttcttccatttattactcacgtgaggtggtatggtgggaacccctcaccattttagctattcgtgccagaaggtgaatatgaagaaattaaggatttatcttagagaagagaaagtgctattgaaacatcttgtagaatgttggcagttaaaagggcatattactactcaatcaatataaagaacttttgaacaagcagagccatctgaagtttgaatgtgctgctttctgagctcctttagatggaggtgttcaaacagcctaaatcttttgagaataccgtagggcataaatcacaactttttaaaaatgagccagctatttgttctttattatacatgaactaagaatatccagttctctaaaacaaaattttggtttttatactgttcactttctagcaagtaccaaagtaccttgtctgtatataagacatgagtgaagagggaggagatgtgtggaataagatgcataacacatagtccttaagcttaattatgccaccctacattttatgatttacggatttcgtattatccttaggaagtttactgtttacttgggaggtctgattttgtttgtttttatactttaagtaagttgtgtcaaatcattcttgaaacataaagggtaaatatctccaaatgggaaaattagacttatacataataaatagagtaatacatgaaatatcacaaagcaacttgtgactaggtgccaaatgtgtgggatgggcagaagagcaatagggacttaggaaagagaaggaatgtcttgctggtagacttcagggaagtttcataaaaggaagaattttaactcagcgtagaaagatgggtaaattttcctcatgtgaaggtgtactgcctggggtgctgcaggctggagatgagtattaaaataggaggagagtgagtgaaagcacaggaggaggaagggtcaggcaagtttggtgaacacagcaactggctatagaacaggagcagtgggagaaagtccagaaaggtctgctgagcttcagttgtacaaagctgtggagtttggcctttggtcatggctagattaggtctgaaagccttaattaaaaaaaaaaaaaaaaaaaggcaggtcttgtaaactgcatttctgcttgagaaattgatctttaaacttctagtctcttttggttttctgagatacacatctaacctattattgtaatataacattgtaaagaaacacacacacaaagcagggaaaatgattgcatagtgatcaaactatttgaaattatgcccagtgttgtttcaaggtcctacattttgtaaaaacaaataaaaacgtacctagatctttgatctagtagttgaataagttgactgtagaagttatgagtgcttatttttcacatttgtttaatcacctttgattgttgcttttgagtgttaaatgagttagggtatataataacaaataataccatttctacagttttgtatgcattacaaaattgtaagggaggaggttgcgttttaactagtgttaaatcctaaatgactgaaatttgtgcaggtaaaaataatcttttacattaatagcttaaagtaataataaaagttgatatattgtctggtatactggtataatatttcataacaaaaactcattaagtgtatttcctagtctatgatatttacatttacttaccttttatatttttaagtaatcaaaatattggaatactttgattcaggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgcctgtaagttaatgttacaacaaatatgttagtttttataatttttagcttcatttataacaaagaaaagactggccagccatctgttagaacatcagttttcaaaatatgatctgcagacccctgaggatggggggggtggttcctgagaccctttctggggtctattaggtcaaaactaattttgtgataaaactgggatgttgtttgcctctttccctgcattgatatttgcagtggtgggtaaagctactggtgccttttcccaatttaaggctacaactgtagaaactatattcattattgctatgtatcagccattaaagaaaaaaatgccagttacacttgataatgcctttgacaaggaaatataaattaattttattaaatcttgactcttagtaaatacgtgcctttgtaatattgtgtgtgatgaaatgggatgcatgcataaagcacttctacataccaaaatccagtagtttctaaaggagaagtatttgtgcggttgttagagttgcaagctgaactagttatttctttcatggaacatgaaatgagtgaccaacaaactatgattatttagatttgggtatttggaagacatttttcttaaggtgaattaaatgagactgtcacttcaaggaaagcaacttaaggctgggagcggtggctcacatctataatcccaccactttgggagggcgaagtgggcggatcacctgaggtcaggagttcgagaccagcttggccaacatggtgaaacctcatctctactaaaaatacagaaattagccaggcatggtggcagatgcctgtaatcccagctactcggggggctgaggcaggagaatcgcttgaacccaggaggcagaggttgcagtgagcctagattacaccattgcactccagcctgggcgacaacagcgaaactccatctcaaaaaaaaaagaaaaaaagaaaagcaacttaagtattttttcactagtgttaaaagttgagatgtcgaaacaaaaattagaattttagaaagctactatccaccactatgagcttgacagcctcccagtgcttagacttttctgataagattggtgataacaaatgtgattattttcatgctgtataatgaaatatgtgaacatttggaagatctgcgtaacttaaggaaccaatattttccacgtgatcagtgtatgataataacaaaattattcataggtaaaagatacattcaaagtgtaaaatacaccatttggatttttaatgtgccagtaggaaaagtttgttgatgtggtttcagattccacattacaactgcctttaagaaaccattttttgagctttggtatagtaccaaagaatattcatcattatttgaacaggcagtggctcacacctataatcctagcactttgggaggccaaggtgggcggatcactggaggtcaggagttcaagatcagcctggccaacgtggtgaaaccccgtctctactaaaaatacaaaaattagccaggcgtggtggcaggcacctgtaatcccagctactttggaggctgaggcagagagaatggcttgaacccgggaggcagaggttgcagtgagccgagatcacgccactgctctccagcctgggcgacagagtgagactcctaaaaaaaaaaaaaaaaaaaaaaggggctattaaaatactccttccttttacatctacgtatctgcatgaggccaaactttctttcatatactttaatcaaaacatcatatcacagcagattgaatgcagaagcagctatgagaatcttagctgtcttgtatattaagctaaacatcaaagaaatttgcaaaaagataggtggtaaattcatgtgagagagagacttctagtagtggaaatgcatgttaagactcactttctaactttgaagaacaaatgattgaatggaaaaatggttgagatagtgaccacaagaggagtttgggtttttttttaagatctggagttattaaggtacataaattcgttaaaaagtacatttaaagcaaaaacattttacagtaaaacctgatgcccaacagtagttgttggctctatgttaaaatacctttaaattaactattaatttttgttaacttaaaacaataatcagttactagctcacgaatctgcagattgggcagggctcagcaggggtggcttatctctgttccttgtgacattctctgaagatgaaaggtccaagactgcttcttcactcacatgcctattgcttcagctgggatactggaacacttggggggctgttggcatctcttcctcctagcacgaagactgggttgcaaagagtattgtttcgagaggcaagtctcaacatgcaggctcttctcaagcctccacttcattgtgtttgctaatgccttattgtccaaagctagttgcatgcccaaacccagaattgatgtgatagggaactacacaagaatgtaaatactgggaggtatggttcatgggggccatcaaaatgaaagtttacaacaagtataaacagaactgtcttccttccccacaccccacccccaaaacccactttgggcatatatgctagacaaagttacccctcattctttttaacagttacatagcctttcattagctggataaatcatggtttatttaatgaatgatatactaatgaacatttataatctttttaaccttttgttactgaaaacagtgcttcaaaagtatttttatacgtatgtcatcttgtacatctgtgagcatgtatctgtgaacatatccataggctggatacctagcaggtcaaaatgacgtgtgcatgcataattggctttttttgtttgtttttactttttagtaactgcttttttaaaaataatggctttattgatgtgtaattcatctactgtacaattcacctgtttagattgtacaattcagtgttttatagtatattcacagggttgtgtagccattattacggtcggtttttaaacatctttattaccccaataagatatcctagacctattagcagtattaaagcaaaataggtagtaggtagcctggggttgtttctacacctggaaatgaaaccaacctttagccaatcacaaacagccagccagcctatttgttatataactagggactttgcataatgccatgcccaagtaaggcaaacacctagctgtagccaatcagctgattcctttgctttgctttgctttgtgttcagcctgtaaaagctggctgttcaaggtgctagatcagagatctctgaacttgcggttttgagtaccacttggttcatgaatcattctttgctcaaataaactctgttaaatttattttgtctaaagttttccatttaacaacagtctctcccaaccctaggcaaccactaatctattttctctatatatataatttgcctattctggacatttcatataaatgggatcacttaataggtgatcttttatgactggcttctttcacttagtatcatattttcaaggttcatccatgctatagcatgtgttagtactccatttttaattgcagagcaatattgtatggatataccacattttgtttatctattagttgatggacatttgagctgctcctgtttggtggctattatgaataatgctactgtgaacatttgtgtacaagttttcaggtggacatatattctcatttctcttgagtttatacctaggaatggaattgctgggtaatacgtttaacattttgaggaactgctatactgttttccaaaccagctgcacattttacattctgccagcactatatgagaattctaattgctttgtggtcttgccaacatttattacccttaactatttaattagggatccaaaaaactggaatttccactggacattgatggaaagaccaagttctaggaaagttagtatagtgagagtgttatatattatcctcaccctaggagcgtttttgtcagcttccactaatttgtttttattgaggaagagtctgcagagtgtatgttgggaggcattccatggcagcgtttgtaaatttcctgttaaagaagattaataaagccttcaatagatcccaggaagttggatttttagtttttactactagacacagcattctgcctgcttatgatatatactttctatgctttttgttttggtttatattagatgtttcaaagaactcaaatgttaatagaataatttataaaattaccacatggttgtctctctcagccagatatttatcaacatttatggggatgactgagattttaaaagttcacctgagatgagtatgtcagacaaaatcatttagcctttgttccataatattttaaatctgacattttttcagactataatctgccacatgactgtcttgtatgatcttctttggataatagtttctttttttttttttttttgagatggagcctcgctctgttgcccaggctggagtgcagtggcacaatctcggcttactgcaacctccatcccaggttcaagtgattctcctgcctcagcctcagagtagctgggattacaggcatgtgccatcacacccagctgattttttgtatttttagtagagatgggtttcaccatgttaacccggatggtctggatctcctgacctcatgatccgccctcctcggcctcccaaagtgctgggattacaggcgtgagccaccatgcctgaccggataatagtttcttaattaagaaatgagaaacgtacctaataaaaaaaaatgttgtgaagtttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcaggtaggattcgtcaccattttatactttattagtagtagtatatggtactacctcaaatttatatactataatgttcttaaatttagatcaattaattccctatagtaaacaaagttaaacttaaaatgtattttaggctaatatttttctttaatgtatttatgaggttttactatcttaatataccatagaatagaaatttgatctatttaataaattcagtgaaaatgaaagattaaatcatggaaatagctgtagatttttcttatatacaaagataatgaagaatatgaattaatagaaactttagtataaaaagttggaaatattgtaaaagtgataaatttagaagttcttgtgaaccacagatgtattaacctataggttttctttttaactctttagaactgcagctgtgcacgtggaacattctgtattcatctgctatttgtgatgctccgggtgtttcaactagaaccttcagacccaatgttatggagaaaaactttaaagaattttgaggtagtttttaataaatgcttagagtaaaattgttagcatattcttaggatatattcttaaaatttatccttcactaaatttaggcagtgaccattttaaaggtgtgaaggtatgtaagaattagttgatgcttataaatagttctcatgagatatttactaaactttttcttctagcttgaaaaaaacaaacactgacctgctgtaagaatgttgtccttagtaaaaactataatgtgttcttatttttgaagctcttaaatcaactttatgaaaaacatgcaaattaaagataaataattcagcctctagaactcttcatatgtataattatggcacaaatatcattgttactgtctttttccaatgttaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacaggttagtactttttaaggatttcaaacattaatccagtgttacttttaattttaggggtaattttttatatctacttgttaagttgctctaaaatgatttaattattgaatcttggctttcaagttaaaatcaagggtgaagatactaaaagttcgctgggcatggtggctcgtgcctgtaatcccagcaccttgggagactaaggcagaaggattgcttgagcccaggagttcaagaccagcctgggcaacatagggataccccaactctacagaagtaaaataattagctgggagtggtgatacctgtagtcccagttactcgagaggccaaggcaggaggatcgcttgaacccaggagttcaagtctccagtgacctatgatcgcaccactgcctaggtgacagaacaagaccctgtctcttaaaaaatatgtgggtgtgtgtatgtatgtatgtctgtatgtatgtatgtatgttaaaggtcatgtgagtgtgtgtgtgtatatagacgttttgtgctaaaaactacagcattcatgtgaatcttctttctgttctgtatattgctttattggttttagtgtaaaaattagatttttaaaaattaatccacaaaggagtgctgcttctcttaccagggcaccttctatgttattcccgaagtgcccagtttgagaagcattgttctgagtggttaaatcctgtcttcatcctattaatctgttaagtattgtaactacctcaaaattcatgaagaatgaaaaagtgacagggtcgtaacaagggtgcagtgaagagaagagaggttttcttcatctgtggaaaaagtaaatgtttgaagaattttcttaattttgattaaatgaaataattttagaatcctagagttttacgagtttttagacattgaagattttctagttggcatgtctcagtgacacagcgataagtgaagccaagaggttatgcagctcatttgaggaaaggtatagccagaacctgggtatctttgttttacccctcatctcttctaaataaaatgaaaaaaatgagctttatttctccagcctcctgaactcctagccccaagcattcctcccacctcagcgtcccaaagtgctgggattacaagtgtgaaccaccacacccagctcctttttccttttgagtgacatttctgtaactttttactgtggagaaaaataacagatgcttaaaaccaagtagtcaaaatagaaagtttctctctgaggttaaatatatatatttggatttgcatatccatggggggaatcacaaaagttatcttggttactgagattgtactgtacatacatagatagatttttgtttcgtataaccactatttttatatctaagatcaataaaaagaaaatacagaggaaatttatctggaggtctgattacatacaattttaaatgttatgcccaaaacaataataaaagaattaggataaacaaatttaaaattcaattgaaaatgaagggcataaagagaatatccaccaaaaaagaattttaaggggctaagaaacacaaaaactgttcagtcaacctaataaccgaagaaatgttcattttttaaaaaaagataccagtttttatttaccgaaataatgaagactttttaaatgatgtaattcagttattgtaagcatgtgcttgatcgtatgtaaagccgtatagccttttgaagaaaaaaggaatatggcttttaaaaacatttatattcattgatccagtaaatgttcttcttaagtaaaagtttaatctgagaaatgcaaaagcctcacatatatcatatatgactgtttctcatagtattatggtgaaaaagtagaaacagtttaaatatccaacagcaattgaatgattaaattagcatatgcccatgttacaaatgtcatgtaggcattaaaattatgcttttggagaacgttgaatggcctgggaaaatgtcgataagtaaaaccaaatctaggttataataatatattatgcatgaacccagttttatatagaaaaggtattacaagtatgtaaaaatcggaaggaataaaaacttcactggttattaataggaggtgctattatgggtaactttttttaaactttaaatattttgtggtccatttggtctcttttaaaactactcagctctgcccttatatcctgaaaatagccaaagacgatatataaatgaacgggatggctatgttcagtaaaactgtatttacacaagtagtccacaggctgatttgttttccttataagttcattactccctgctctatacttgtaattttgcttcagaaaaaactatgctaaaaaaaatctgaaacgtcaaaaaaaaatgagtacaaagatgtttgtaatggtttctttctttcttttctctttttttagacggagtctctctctgtcacccaggctggagtgcagtggcgtgatcttggctcactgcaagctctgcctcccgggttcatgccattctcctgcctcagcctcccgagtagctgggattacaggcgcctgccaccatgcccagctaattttttgtatttttagtagtgacagggtttcaccatgttaaccaggatagtctcgatctcctgacctcatgatctgcccgtctcagcctcccaaagtgctgggattacaggcgtgagccaccgcgcccggccgtaatggtttcttaaaatgtaaaaatatggaaacagcttatatgtccaacattaatggatacttaaaacaggatctatctagtcagtggaaaattatgatggcattaaaaattatgtggtggaagcaacccaggtgtccatcaataaatgaatggataaaatgtggtatatacacatagtggaatattactcagctttacaaaggaaggaagtgtgctacaacatggatgaacctttaggacattattctaagcaaaataagccagtcacaaaaagacaaatattgtataattgcacttacatgagatacttagtcaaaaccatagagacagaaagtagaatgagcctaggtgggaggatatgttgaccagcctgggcaacatagtgtgaccctgtctgtaccaaaaaaaaaaaagagaaaagaaagaaaagaaaaattagccaggcatgggtggcatgcccctgtggtcccagctactcaggaggctgaggcaggaggatctcttgagcccagaagttcaaggctgcagtgagctatacttgtgccgctgtactacagtctgggtgacagagcaagaacctgtctcaaaaaaatgtagaatggtggttgccagaggctggaggaaggagatcatggaaaatggtgtttaatgggtatagggtttcagttttacaagatgaaaaggatactggagacacatagtggtgatggttgcacagcgtgaaggcatttaataccactcacgtgtacacttaaaaatggttaagatggtaaattttatgttttgcatatgttgccacaacaaaaaaaagaattatgtatatgaagagtttaagtgcaattttataataaaaatttttaaaatatgaaatagtgcatatatatacataaatgatctgaacaatgcttacaaaatatgtacttggaaaaaagatgggcaggaaataccccggaatggtattctttttgttgtcagagaagtatttaataagttgcacttataatttgactaaattgtgaaactttattttcctctatgaataagcttaattttggtataattatttgaagggttagttgaccttggattatttttgccatgaatatttttattataggtagttgtatacatcatttctgtaatgctgctgttaattctttgttactaatgcatgcatagtcttgacagtttttccccatcctaagtagctccataattaggaaaagagatgggcaggtacatcaggagggacagactagtaagtgtgccttcatcacaggaatcacgcattatgactttgctgacttgtttgactagctttttggaaagctttttgtgcatttggggaactggttattttgctggtagttactcagatctgtttttcagggaaaagtagttactgtttttgccattacttctaatggcaaaattagaattaaaaaaattagaagtaatggcaaaaaccgcaattacttttgcaccaacctaatagtttaagatagtagaagtgcaatattgggcctagcttagcagactctgaaatttatagatgttgtaagtttatggcatattcttctcagataaaagtgtaatgatagatctgccacaaactgattttatgatttgaggcaacttatttaacatcccagagccttgtctttatattataatgaaaatacggctattgattttaaaagccatccctcacatcatgaaggtttaaataaaaacatttatgaaatagaaaactaaagccctctttagcctggctgcacacaaaataactactgttaactatttcatacaacttttaaaaattacataaatcaaggaatgaaactcttctttgcacacttcgtacttcagcaaacacatgcacgcacgttcccccatccatgtttctctcaactttcttactgtttttaaacaaatacaaagtcatgccatatgttctggtgtgcagttttcttttacttttactttatatatcaagaatatttttccacatcatcaccaaattacatacttttttcttttcatggctgtataagattatgttggtacaccataatttatttagccattgccttaattaatgtacattaagtacatctccactttttggtttacatacttaaaatatgtagcgataacatcctagaaaataggatttttaggtcatgaatatataccatgtagtattttaagaaatactaacaaaatttccttccagagattttagtttttactcctaccagcagtctatatgagaacctggttttctgtgccattatcagggccagatgttaccaatctattattttttattccaattgcctttttatttcctttgtccattgtactatttattagtatttttctaactgatttttaaaagtactttgtatgttagaaatactcaagtatatgcaatataattaaccattatgttgcgattttgccataaatggaatcatcctatacatggtagttttattttgacctcatttatggatttctctgttcctttttaaaggcttcaaggtgtctgggtttgccataatttgtttagcctctttttggcattcatttggttgttttgatttcttttcgttattctaaataatattgcagtggacattttcatacatatatctctatatatttatctttttattttcttacgatacattcctagaagtctaggtgaaagattgtgtacacttaaaatgtgatgtgttcctagattcatttctgggaaagttggatcagttcatactgccaccagaaatttctgaaataggcatttaaatttaggatgtggaatctttgagctctaaggtccgccagtacttaaaatcttgaaactggtaccatgtagtgtatttttatacatagtcaaacctgttggtctattcaaaaggtacagtagcagaatttgggggatacaaatgtttctttctaagattgcagtctgtgtattgaattgttttcatagcaaagaaggttaactcacacctacaatctataaatactcgtgtgttaatctgattttaaattactgtatattaatagtgtaaatatgtatctcttagttatataagatgctcttaagaatttctaatgtatttatattctaagcaagcagaaagtgtttttagcatatccgttctactttatattcttttatgcttaatactttttcttccccttttctatagcataaaggatgaagaggaacagatgtgtcctatttgcttgttgggcatgcttgatgaagaaagtcttacagtgtgtgaagacggctgcaggaacaagctgcaccaccactgcatgtcaatttgtatgtggctctttttctccctatgcttactcaacacagttgctctctgagctaactatgttatttaagagtgtaacatggcttgaggggaaattggtgagagaataaaaaaagtatatctaagtcctaagtcctatgtgaaaagttttcaacaaatgggaatgtaggatctttaggagatgacctgtgtgagcaaagaaatgcaataaagtgtgtgtgacatatgtgataatggaagaagtgcacagaattagaaacaatttcaatctggaaggtatacatgaagggaaggaggtggaagaagacctgggcaggcattacagaaaggctagcatcaaagtaaggtttggaaggactttacctggtagtcaaacagggcagaatgttttgaaaaatagtaagcagagtacatgttatcagaatgaataaaatagcatttgcaaatcaaaatcatttaacctgctgtgtttacttgctttcagataaacatttaattagattatttttgaggttccttctatataaattctataattataaacagttatgaaataaaaataatgttaaacatttacatttttgtaagattttgtttctgtaatttttcaggggcagaagagtgtagaagaaatagagaacctttaatatgtcccctttgtagatctaagtggagatctcatgatttctacaggtaataattttgaaatgatacggatatgtttaatttttaaaaatttctcagtgtggtttgtcttaatttttttaaagcaagttttgttatttttcattttagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtaagtagttctttgtttttcatttctcaaagaaatatttatagatcaattaatgtatttgtctccttccctcagttgttcataatttaaaaaaacacttttacttgcctccatcatgaccttcattccactggaaattttaatgttacttttggtattaatactatactgcttattgtacagcttcaacttcaaaacttcttgtggtttcacttcacatatctagaaacatctcttcctgaactaacggacatacggggttattcaaggatagaaggatagaaaccagaacccttcaatgctaacttttcccaatgtttaatccccgtgcctgccaagaatttttatcatgtttcttatttgctgccatttaaaattaatttctcttttcatatcctaatggcatacaatgggtgcttaataattgcagaggagatgaataagaaaaaaatatgtgatggttaccttgagttcatcatttttatttgtaagaacagtttcccatccctttaccatctcttctgattgaatgttttttcatcctcagtaagtagggcttttttgtcagttggtttgtaatgattttcttggttgttgaatgctcagtctattattttttaaatgtaggatctaaaaccagacgggtctccagtagacaataataaagtaaaataattattttcaataatctgttaaattctgttgaattaaatttgtgaacaggtgcattaacacattgagcttatatatcattaggatttgttacatttttcttttgtgaccattacagtcctgcagctttggaattctcttagcatattagcaacccatttatgaatctaataaaatctgcaaaaatattaaacacattcttgtacctagttcattaatgaaatttaatgaactattaatgaacataggccctcacctgccctttcatgacccatcaaagaactctcaagttgattctgagctgttagagttcattctttcaagcatatggtctagtttgttttgcctaagctttaggtcagactaggctctacattcctagctttttattaagcatgttaggtaagacagttaaaacataggtagtggtacactacttaacagtaccagaagctcactatattctagttggttcattctcccataatatccctttataacaaaacatatgtaaataagtatgttatgatctgtttttcaaaagttgtgtttattcatctttaatatttaggcatttttcacataatgaattatcttaggtattaagcttacttttagctaattggcccataatgtcaagaccattcaccctttcctcactgtagggactctggcttttggggcatggtattgacgacgataacagcatatactataattctacgtctacatttatcctttgcttactcgaacacaagcattttttcttcagttgtttgatttgtccactccattcgttttacagtcctacctgttttgtctagttttttaaacctttttatacagacaaaaaccaattaaatgtgttttgcttattgctcttgtctgtaagagaaatactctatatctcttgaaaccttctcctggtgctttttttgatttgttttttgtttgtttgtttgttttcttaatcttgctccagtttttctctttaaactaccttaatatgaatacagagttgaggttttcacagttttttggcgttttggtaagcatgtgggacagtagaggcatagaatgtatgtatagccatctagtgacttaatggagcttattattaattttacctgagctaataaatattaatgactttggataattatcagttaaacttgagtataaaattcttccttatgatgcttaagtggctggatatatttgaagttgtgaaggatggtaaagatttcagaaatgtccagtttttacgtagtaatcaaaaatgatgctaaactcaaaatgctctgggtccataagcttttctttacattgaattcatcgtgtgtgtttgatacaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttagtaagtagctttattccataatcatatcattatgggtttggggttttttgatggttcgtagatagtgtttttaagatacaataaagctactttacctaattttggaaaatccaaattttatttttattccataattccaggaaattacagcttttgttttgtttatttgaattttactgatttttatgatgtccaaggtttcttatataactgttttactttttagtttcattgttttaaaggctttgcaggggtatccaagggagagaatatagtcatggtttcttagtttctgtttgggccagtaaagctccttcctcatcctccttttccacttaccactagagacagactaaaaaccatggcttcaggctgctaaagcctaaaacaaaacaaaacaaaacagaacaacaacaaatagggtgagctagacaagcttgctaatttttaaagatttttttaatgtcttgctgttcatatctgtacatttttctgagcagataccttatacatgaccaaattaaaaatgctttttgggatggcagagtcatcaacgttattctgattttttaaaaaatttatcagatattaaggaagatatgtttttaataaacattttgattgatttttaataaacattgtcatgtggagattcaaaagccttttcaaagaaaagggttccatgacatagatcattgagttgttttccagtttaacctgttaaaagttctttcatgggtggaatagagtgacaaggaggtaatttaggagactaactggactttctccattctgcgtatatgtctctttagggcttctcagcctcagtactattaacatttgttagataattatttgttggagggtggggggagggccagggatgttgtcatgtgtgtactgtggcagcatctctggcctctacccattagataccaggagcaaacccacccccacccgatcatgcccccagttatgacaaccaagaatgtctccaggcattgccaaatgtctccagtggtcaaaactgcccccaattcagaatcactactttaattcttatctagtctgttcttaaaattcatgagcagtctgtaggcttcctccctcagtctttttctaatgcatcctctaccgattgggcctaatgaatcttcttgacaggtaatacagcatgacagttacgaacatgggtttggagtcacaattgagtgatctcataatttatcattccaaccacaatgcttgcataatgtgctggttaaagttggactagcctaggcaatctgaacacatgatcaagatcatagagacagacctggattcaaattctggttctcccttttactagcacgatggctttatgaaggttacttaacctctcttaaataaacttcagttttctcacccataaaataatgaaaataccttttaggtttgaaattagattatgtagaaactttcaaccatatgcctggcacattgtaagaacatttaatattatataatagttatcattatttcttaaacacaacttggattatcccccaaatcatttagaaacctttagaggtttctgtttctttgacattcctaaagcatattctgtggaagtttggcagggttgtgaaaagttccctgaagaaagaatcccgtattcagttaagattggtgaacactggattacacaaggataactaggtctgttgactgaaaggcttctaggatccttcagtaagctaatgtacattgtgaacctaaaggatcaaaggatagaatgcattgtttcccagagttattttgctacaccttgttttttcatgtagcatctggagggaccagcatactatagaataaagaccaattggcccaatattttgcctcttacttagtattttccaacacaaaccttcaggcatacttgactaaataaaatcctctttttgctagttccttttctgcaaagcctttgctgtgttactctttttgtacacaccgtaactgccttactgttgtggttgtttcttcttaagttcagactgtttcccaactagcttatgagatcctagagcacaaagattgtataaaggataccaggctccatggaggcagaaatggctcctgctgttaaggctcaccctttccctttctcttatctccccttcctctgtctcttcctttttttcctctccctccctctgcatatataatttttttttttttttttgctgaatcgtttgagagttttttgcagcatcatgacacttaaatatgtgtctcttaaaaccaaatacataattccatttattcttccatatacagtcagcacattaacattaatcacaatactgttttgtactataaagttcatactcaaatctcttcagttgcccaacagtgcccttcatagctaaactgcagactttattcagatttcaccagtttttctgctgttgtcttttttctgttccaggatccaatccaggatcccacagtgcatttagtcaccatgtccccttaatgtcttctcatccatgacagttcctcagcctttcctggtttttaatgaccttgacagatactttcaaagtttactggccagttattttgtagaatatccctcaatttgggtttatctgatgttttctcatgattagatggaagttacgtatttttcacaagaacgccacagaggtgacaggcctttcttagtgcatcatatcagtgggtacatatgcccatggcttttattattggtgatgctgtcagttaaggtaatgtctaccaagtttccctgctgtaaagttaatattcctaaatatcttgtgagagttactttgagattatgcaaataccctatttcacctcaaaattttgtccactgattttaaaagcatttgtggatcttgcctatagcagttattactacaccattaaaaatggtgctctcttgggcacagggaggggagcatcacacactggagtctgtcgggggtcgggaggtagaggagggatagcattacaagaaatacctaatgtagatgacgggtcgatggatgcagcaaaccaccatggcatgtgtgtacctatgtaacaaacctgcacgttctgcacatgtaccccacaactaaagtataatttaaaaaatggtgttctagtggtgattttctattttcctcattccttctacattaattaattggaattattctataaagaagagcttctctgtttatatacctattcaatttttaatttgtattggtgtaggctcctgggtattcattttgttctgtgggttgcaacccagtactaccatcatttgttttgttgctctaattattccagccttgaccattgggagctctttcaggttggcgcctgttctcattttcttttttaaaataattttttttaacttttcatcttgaaatgaattcagacttttaaaaattgcagagaaaagagttcagaaaattccttcctgccccattcatttattttgttagttagttgtattattacagaagcatggaattcttattttattctatgggttataatccattcctgtctacttattttgttgctcaaattgtctcaaattaggccattatctctgatgctttttaagtgtacataaactgaccttcagatttttttccttagaaaacattgagagccatgctggtatatactccttgccacagtttagcggaaagaatcaaacttcagagacttctccagccagttgtagacaccatcctagtcaaatgtgcagatgccaataggtaaggctttattgatgaatcacttcaaaccctcttgtcttaaaagtgcctcgcagcaagcctcacacctagtgtgaatatctgatacattttattaaatgagtctttgaacattgtcttttaatgtgagatttaaaatgaaaatgcagcataaagctcttaaggactggcggaaagaactactggcaagtaaaagccaggcaaacaaactgcatggatctccacattattgtattgtgatttactctctttagtaacattcataatctgaagaccagtcgataagaacagtagttgacatttatatctataagttataatctcatattagagtatgggttacacagaataggaaccagtaagatcattacacctgcatatgccttattatcaggataaaaaattaacaaatccatctcattttcagtgtagtggaattttactctacttatgacagttttgtcaaaaaatttttagattttttatattcctgcaatatccttaaaaattgacagggaacaagaataaccctaactggaaagaaaaatatgaagtagagaattgaggtacaatgacagtaaagatgagtacaagccatgcttttttcagaccaatggttctcttttattttccccttccataaaataggaggaaaagatcaattttcatttaataatcacagctactgtgaacagttatttggtagttcctatttctttctatcccagcagatcttggttagcaagaagtgttgaatctcccttctgttgcctcttccatttcacccatttagagttctctcagtacaacctttctcttcctctgcaagtcataatgacttagtttgcacaggatctcaaaaattaggtacctacctttaacgaatttctcatatcatgaagtctgtcttttgcctctattgttttctctatagattgaaaatattggatgtttccttgttgcttagagaaaacattgtatatctgtaaaatattgcaaattaacaagtaatttgcaaaatgcataggaaaaatgtcatttttaaatattagaataggtatatttctgagaattcagtgttctcatggtatttgttatgctgctcactttttgaaactccaaacttaggttgtttacctggtcacctgaatgactgaacataagaaatactgtagagagattttataatattcagacctcattttggctatgtaaggaaatggagggtttttggataggaaggttttgtttttaattcaagagcttcttagtgaaagttcagaaatcaaaatatcaaggtccttgttttttcttttaacaaaatataagacttttatctgatttggtatttaaatcagtacttgcaaagagccattgttgaaaattctgtgcttaacataggggatatgttaaatttacgaaattagacctaataaatgaatattactacttatggtgacattgttaatatgattttagtggtggaaaagtaaacactcctgaaaacattatttctccactttttcacaaggcattacattactcctctaatattgtatagtgttttagccaagatccaggattgatgttgcttttcctttgtttttagccgcacaagtcagctgtccatatcaacactgttggaactgtgcaaaggccaagcaggagagttggcagttggcagagaaatactaaaagctggtaataacttttcacttaaaaggaatatagcatattttatcatgttcctgagcagccttgtctaatctcataatctctcatgaggcagtttacaggattttgaagtaattttataaattgattcactgtgttacagttagaaatgtgaattactctgagagagaaattctttaaaatagttcagaatatttttgttggccttacaccatttaatcatgtcttgttttagattttaatatcactattttttaatcatttatttttactttcctttttgtaggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtaatttttcttctgaaaatgtattacttgtatcttcctaccctccctacaccctcctcaagaatgacacattttagatttttgaaagactcagagcatgaataggttgctgataccttaatatttgattgacatatgaaaacccaaagtctgggctctttaattaaaaattcatagatactttatgctgaaatggtttttgaagtatacatgctgtaaattactaccattttttaagtttccatgtatttttcagtaattggaacttatatggtaatgaatgtttttttctttcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatgtaagtatagattctttaagaggttagaaaacttccttggggctgggcacagtgactcatacctggaattccagcacttggggaggctgaggccgaaggattgcttgagcacaggagttcgaaactagcctggtcaacaaagcaagaccctgtctctacaaaaaattttaaaaattagccaggcatgatagtgtacacctggggtcccagctactcaggaagctgaggtggggagggtcacttgaacctgggagtttgaggctacagtgagctgtgattacaccattgtactctagcctgaatgacagagcaagacactgtctcacagagagcttccttggaccatactaaaataaacctaattcagaaatgctgcttctaacattcagaagcagagttttccacataaaattattacttatacaacaataatgtttgtactgtttaaacagcaataattcttgcctatgggcatttccggttaattgtataatggtgattacttttgcatttgctgtcggtcacaaataccttccattcagaggtcacatttataggtggtttgggaagccagactgaataagaataatatcttgcagactaatttcacaaaatcttactcctttaacagtaaaaagattgctttcgtttaatatgtagacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtaaatatctagtgagcatataaatgaaatgactcaaatcacaaaatgaagcatgttcagtaaaaagaataaaggatatgtccacgtgtgtgtactttagttctttaaactttgagaaacttagtttcaaagtagatgtttctaaagcaccagaaacatcatgaattctgttattgttaaaagttgaggccacgcgtggtggctcacacctgtaatcccagcactttgggaggccaaggtggttggatcatttgaggccaggagttcaagaccagcctggccagcatggtgaaaccctacctctactaaaaatacaaaaatcggccgggcagggtggtaggcacctgtagtcccagctactcaggaggctgagacagaagaattgcttgaactcaggaggtagaggttgcagtgagccgagatcgcaccactgtactccagcctgagcaacagagcaagactgtctcaaaaaaaaataaataaaagttgaagtatgattattgtaagactacaatatcaagatgggccttacaaaggtttttttggttttgctttttgtaggtagtagaggtggttttcaggtacttctttcaacagtgtacttgtgcggtgccatcttggggtttcagtggtttactttttattataacgagcatacttaatcaggataggaaaattattaaactttcatttttaaatcatgttgattcttctcccatatttgggcttttctcatctttactctgagactattggaatattgactatatcccaatatttttgtcatttttctgatgtttactgctgcttaagctagattcttagtgtttaaaagagtttgacttgggtttgtttaaagtacattgcatccataagcataaatgccatctgttgctaataaagtgctagtttgcatttgttcattttagatcagattgctagtgaaaatatgcaaaactttgtgaacgtgtttatttgaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcaggtatgttaatgttttaaattacaaaatagtagtacgtggatttaactttctgcaatttaggaaaaaccagtttaattaaaatttatttctatcaaatagtttgggtttctaaaaacaaatcaccccaatatattagtatgaaccacaaatacttcgttttgtatttcatttactataaatgaaatattgactacctctaccttttaaatttttccagtgtgtttttaaatgattgtgtagcattgttgtttttaatacttgatatgtataagatatgtatatttccaggtagccatgataaattggacagatgaggaagtgttttaacataacaatatacaaacaaaattaacatataacttgaaaacttactacaagtaaactagcactgaagcataaagttgaaccttgtcatctgctgaaataaatgaagactgagttttattttgtattatacaatgtatacaataaaattaatgacctgatgtgatgaacagattgtttggtttaacttcttagatttgtgtgtgtatttaagagtgcatttctctttaccagtcagttcttaagtatgttatctgttggttggtcttaataaagatttacactacagtagataggttgactactataaacacttttaaaagcggctaaatttgagacatgttccaggtcagagctagtaaatggtagaatatgacgcctaactctgggttttctgttcctcctcccattctttccaccttttactacataatatgttaacattgtttactttagtcattaataaagttgttttgtgtattttgagaagacagagaattgaattgtacatttcagaaatagtttaatccgaaattgttaacttttacagctttctgaaatcttgactctccaataaactggtttccctgtgggttctgtgaaaatgtctcctaattagtaggtttttgagatgatacaggaatatgttagttttgaaatgtttttcttctgtttcagatgtgaatgtgagttcatgcagtgaaaactttagaaaccaaagtgtaataaatacttttaattctgtcttaagtttatgataattatttctattgtcttatagggggatcggtggctcatttgctgagtaaatatggagccttcaaagaatcagtagttattaactacactgaacagttactccgtggcctttcgtatctccatgaaaaccaaatcattcacagagatgtcaaaggtgagaattcttctaattattatctagtgacaataaaaaaattaattttaaaatttggggccaggcacagtggctcacacctgtaatcccagtactttgggaggtgaaggcaggtggatcacttgaggtcaggagctcgagaccagccaggccaacatggtgaaaccctgtctctactaaaaatacaaaaattaacagggtaaggtggcgcatgcctgtaatcctggctatttgggaggctgagacaggagaattgcttgaacccggaaggcagaggttgaagtgagctgagatcacaccactgcactctagcctgggtgacagagtgagactctgtctcaaagaagaacaaaaaaatggacctttgttgatagtttctaacagtgggatttttttctctgagtaattcagaatattagaactgaaatgagccttagggatcatttaatctgccttcctcgtttaatagaaaagtacattgaatacaagagaggctgtgccttttctacagttttattgctagttaatggcagaaagtatacaacacaggtctccagattccctgtcttggcctcatgatacgctgactcccagaaagttccttttcctggttttattttgaataattgggatattgggatatcatcaacttcttttaagaaaaattccttcaaatcctttgtaggtcccattattttccttatccttttcttttttttggagacaggttctctgtcactcaggctggagtgtagtgttgcaaacttggcacactgtaactcatttcctgggctcaagtgatcctcccacctcagcctcccaagtagctaggacaacaggtgtgcaccaccatgcctggctaattttttatattttttgtagagatggggttttgccatgttgcccccaggctggtcttgaactcctgggctcaagcgacccgcttgcctcagcctcccacagtgctgagattacaggcgtcagccaccgtacctggcctcagtttatttttctcaagagcaaatttggttttctgtcattagtctttttagctagtatttgacataatgtgttgaagtaattttataactttttaaattaagctctaattatgaatttagcgtacgctagagagagctgtgtgcctttagcaagaatgaagtgaaaggaaaagagaataactgtttgcacctctgacatgtagttcacttctttcttttgtcattgtcctagttcattagtattgtactgggcttttatctgtccttatttttgtttttaacatacaaggtcatttgctgtgtttgttgacaggtgccaatttgctaattgacagcactggtcagagactaagaattgcagattttggagctgcagccaggttggcatcaaaaggaactggtgcaggagagtttcagggacaattactggggacaattgcatttatggcacctgaggtgagaagcatctttgagtgtgatgacagaaaatattttggaattctgtgtaacagcattatactaaattatcttgcagtggtatccagtatgtacttaccaactagaagtccgtggcccttaaaatacggttttaataatatctttcagacccttattctcgacctttctttgccttggcaatattcaaaaaacaggttttaatagatttacttaacggctgttactaataaagaattctggggtaatttatagcagttgttttgtaataaactcaaagtgcacataagaaatttttaaaaatattctctctctattctaaaaggagatgagcatacagaggcagctcctgtctgtagtggaaggagtttaagcattgttcttctgactcagcttcttctgtcgtgttcataattcttcatgttcatatgtagtaatgatctgttgtcctcttgccacatagtttgctaagagcaaaattctgtgatgggactctgcttcagaatctcacaattctccaaaatatttttgtgctacctggaaaattaagctcattaatgaaataaattagatattaggtagtccacagaattcctgtttgtaccagttttctccctaaagtaaggaagtagaatctataactacaaaatggccttctctttttcaaatgagtcctatttccaaattaactctgatttattttaggtactaagaggtcaacagtatggaaggagctgtgatgtatggagtgttggctgtgctattatagaaatggcttgtgcaaaaccaccatggaatgcagaaaaacactccaatcatcttgctttgatatttaaggtaattgtgagataaaaattacttctttgtgctaaaaggagtacagcagaatttggcaggaggcaaattttgatgggttctccctaacaatctagcatgaaggtaaataaatagtctgtatatttattcagagaggatttgatatacaagttttttactttaagatggtgcaaaagcaatacaaatttggtaaaaaccatactttgaattttgatttttgtctgagctagcaatatgtgctatgatacactggtgatgctaggcagtggcagcgagtcacagctcccagtcagccacacaatcacgagagtgaacaaccaatactctatagtggactgtgttgtcagatgattttgcggaacagtaggctaatgtaggtattataagcacattcaaggtaggccagactaagctataatgtttggcaggttaggtgtattaactgcattttcaacttaaaaaaatatcatcaacttaaaaggggtttatcacgacataacctcagcgtaagttgaagagcatctgtgtatgtgtgtatttccaggagttgatattgtcaatggtgttgtcaatgttagtgacatacatagtcacttcttgttatttgaggtagttatgctctgttaagttgctacaaatattgaattagcaaatactaaaacactgcttctagaagaaatatgtagtgtgtttatatgtatatgtatgtgtgtatatatatccatccatcactttaaaaacgtgaaattcatgcattttacataattcaaaaatcttaaaatctaatttaccattttcttttgttcgtttgttttttgtttttgtttttgagacagagtctcgctgcagtgcccaggctggagtgcagtggcacgatctcagctcactatagcctccgcttcccaggttcaggcagttctcctgcctcagcctcccaggtagctgagactacaggcacgcgccaccatgcccagctaatttttgtatttttagtagagatggagtttcaccatattggccaggctggtctcgaactcctgacctcaagcccacctcagcctcccaaagtactgggattacaggcgtgagccaccactcctggcctaatttactattttgtatattttaaaaattcacacccaagtcagttcagtcctgtctgcctttcctacttttttataactcacaaatccattctctccttttccaccatagaataagtaatggttgatattcttagcttttcagtagatgtgatggttgaaatcatgggctttggagtcacactgacctagttttaaaccctggctctaccccttaatggccatgtaatcataggaaaattattttttgtgtctaccctccattttctcacatgtaaaattggtgcaagaaccccatgaagcatgtacttcgtgggattactatgaagataaacaaaattatacctaggccttagtcaagcactcagcccacacagtcagctccacctgccataacctcctccagtgctccccacacttattatataacctcctcagtcacctctctgacaatacctgttttgtattatcacctcatttcctctattctttcagacgtcccatgtccgttctctacgtggttcaaattcttattctctttaaggcccccattttgtgcttctcctgcttgggcaccccctttttactcattccagattctcatagcattttagtacatacttgtttctgacactttgtttcttgtttgctagttatgttcctatcttgctgcctctttcaaactaattctccttgaggtccattcatgtctgattcattttcttcttcccagagtcttatacagaagttgctcaataaatactcatggctaggatcaatttgaaagtttgatgttattttaagagttttgatgagaccctggaaacaattgtaaataattttcaaattggcacagttcatattttaacagatttcattgcattctccttcctaggtagagtttaaagagaattgtactgtaacattttcagtttccttaatttggagtaaatactttgaggtttttggaagcaccccaaagctttctcaaacacttccataccctgtttatggtagtataaattgccatagcacgtttttttagagagtgatttggcaatatctgccagaatttttaatgcacttattctttgactcagctatgcccattgttaggaatttactcaagattacctctagaagtaccaagtgccaagttcaggattattcactctactcaagaaagtaattaaattatccacactatacagaaattaaacgagtatgaagctgttggtgttgatttacaaagtgctacaagatacattaataagtgaaaagagcaaggtatataaagtgatcctggccaagcacagtggctcatgcctgtaatcccagcactttgggaggctgaggcaagaacaaaacttgaacccaggagttggagagcagcctgggcatagcgagaccccatctctaccaaaaaaaaaaaaaaattagctgggcatagtgagacgcacctgtgctccagggtactcaggaggttgaggtgggaggatcgcttgagcccaggaggtcaaagctgcagtgagccatgttcatatcactgcacttcagcctgggtgacagtgagagcgagaccctgtctctaaattaagttttctcttttgtagacattttagaaaatcttaagtctgtgaatatattggccttttttcctccacaaaacacacacagacacacacacaccccccccccccacacacacacacacaaatcatcagtaagttacatttggggaaaagaaggaagagggactttttttgttttgtatttttcctttttgtggtgtgtaagatgtgtatatatcagctgagtatatcatgatacaggatcacagaccttagaggatttttctttatattactttgcattttttaacccaaagcatttatgaaattactggggtagggaaaagagagttttcttgtgattaggagtggataggtgagtttaaagtattcagacttgatattagccctttgtcagatgagtagattgcaaaaattttctcccattctgtaggttgcctgttcactctgatggtagtttcttttgctctgcagaagcgctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaatttttttataaggtgtaaggaagggatccagtttcagctttctacatatggctagccagttttcccagaaccatttcttaaatagggaatcatttccccatttcttgtttttgtcaggtttgtcaaagatcagatggttgtagatgtgtgggattatttctgagggccctattctgttccattggtctatatctctgttttggcaccagtaccatgctgttttggttactgtagccttgtagtatagtttgaagtcaggtagcatgatgcctccagctttgttcttttggcttaggattgacttggcaatgtgggctcttttttggttccatatgaacttaagtagttttttccaattctgtgaagaaagtcattggtagcttgatggggacggcattgaatctatgaattaccttgggcagtatggccattttcacgatatcgattcttcctatccatgagcatggaatgttcttccatttgtttgtgtcctcttttatttcattgagcactggtttgtagttcttgaagaggtccttcacatcccttgtaagttggattcctaggtattttattctctttgaagcaattgtgaatgggagttcactcatgatttggctgtttgtctgttattggtgtataagaatgcttgtgatttttgcacattgattttgtatcctgagactttgctgaagttgcttatcagcttaatgaaactgaagaatgctaaagacaagaaggaaccaaagagaaaagacaaattacaagaaaaaaaattgataacaattatatggataacagaatacagcagcaacaagagaattcaaaagacaaattgtaccttctagtgattgaaataaaataacagttaacctaggatttcatagctagctaaatgatcatcaaaaaataagaatgaaatagagatattttcagacacatgagaattgtggaagtttaccttcagcagacactcactgaaaaaaattatttttaggaatgcatttcaagaagaagaaaattgataccacaaatagggagatatgcaagaaagacactatctctgcctggagtcagctctgattcataatgggtgctcaaaaattgttagaaaactaatacttttttttatatatgacttgaaattaaaatatggttattgcagcacaaattttagaatgtaaagagtgtatcacaatttaaaaataattatcagattttgaatttttttagaaaaactacaaataagaccaaataaaatttctttttttttaaaaaaaaagtattcagacttacaatttgtttataaaaaagttattcttcatagtgtatttgatactaagaatcagaatttgtccaacacggaaggaaaaaaacaatgcagttgtgttttctatgtattaaattgactcttcagttttagtctttcttaatctaaatagctctgtatgctgaagaaatagaaaacgtgcagtaagaacaaaccatctcggagattgaatatgaggacagcagaattcatttgagtgaatactttatctacctgaacattttgatgtacttagccttgttgatgtaaataataaggaataggatatatttgatcaaatcctaaaatcctaaaatttgaaagattgttagagaaaacctcccatccagtggatgaattttttcatagactttttgatagcagaaaatcctcccacttctgcttcagttcctctctgttcaggatgtaaatgtaagggttatgaggtctatgcacatgtgtttctgtatcagaagttacagttgtgcaaagcttcaacactggctttttctccacagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaatgttgttacttttatttattttgaaataatttcatacttatataaaagttgcaagaataccacagagaacttctgtatacccttcacccaaagaccccagtcaggtttcaccagctgcccatttatgtcctttatagcaagaggatccaaaccaggatcacatgttgctctcagttgtcatgtttcttcagtctcattgaatccagggccattccttagttcttccttgaccttaatggccttaattttttaaagatttcagattattgttttatagaagctcttcaaattgagtttgtctggtgctgcttcttgattagattcagagtatgcacttttggcaggaacatcacagaggtgatgctgtgctcctctcggtgtgtcatgtcaggaggcatagaggtcgtttgccccatcactggtgataactgatagtaacactgtatagttagtctttccttttataattaaaatccacctttataattggaagtattctttgggggtgatattagagactacataaatatgatgtttcttgcccagttttaactctgctcttagcttttttgcctgaatatattactctgatggttgccaaatggtgatgtagttccttcactttttctttgcaacattttgctgcaaagaagagctttcccttctcccatttatttatcatgtatcatcatatatttgctcaacttgttgcggatttgcccagtgggaatgtctgagagctagcttctctatccttggcaagccaccattattctttgaacacttccatactttcagccccatcttacgcaatgtctcctttggccctggaatcagccattttcccaaagagccctgattcctttgatagagaatggtatgtttaaaaccaacatctgggtgctagataggctcaattctactggatgtcaccactccttggctgtcttggtagagctagaatgtatttatgaatatgcacagttcggtgcacacttgcaaagtacgcatacatatacctacctacatacataaaaaccatgagctcacaccaaccttccaactgcaatccaacaccaacagggttcattcaagctttccctttttccaaatttgtaactttcttctcaggcagtgagaatcatgactgattattcccaacatattgacttacttgcttaattcttcctcatgtccctcccccatgtaaccgatctccatgcaaaatggttaatgttgctgagttcagaagccattttgtttctctacattggtttcaagtttctgtataatttgatttgttgttttttttgtttttttttttttttttttttttgagacagtctcactctgttgtccacgttgaagtgcagtggcacaatctcagctcactaaaggctctgcctcccaggttcaaaggatgctcctgcctcagcctcccgagtagctgggattacaggtggacaccaccatgcctgtctaattcttgtatttttagtagagacaaggtttcaccatgttggccaggctggtctcgaattcctgacctcaggtgaaccacctgcctcggcctcccaaagtataatttgattttaaatgtaagtcttttaaataggttttgggtattttttgcaaaagggtacatttctgtcacttaaaaatattaagttggagaaaagttttttttccagatgaagtaatagaaccaattctattgctccttaattctatttaaatgatattaataattttataaaatgggtgacagtcttcatgtcagaatccagaaaaatgttggggtattgtgctcatagaaatgccaatgattgcatttatgagctgatgtaagtcatttgttataaaacaatgcatgaaataactacagtgagggaaaactgactaatggaaacttatacaaattgctgtctttctatgtcatgacgtggtttggccgttttaaattatactataagcataaatgccaggttgagctgtgatta

SEQ ID NO: 5 - DNA, 98571 bp, Homo sapiens
tttcgccctgttgcccaggttggtctcaaactgctgggctcaagtgatccacccacctcagcctcccaaagtgctgggattacaggcgtgagccaacacacctggctgaaaatagtcttttacgaatttcaaagctttgatttctccataagtgcactcctggtaacttgagaacattacacatttgtctcctttctgtggccagaattgttttgtatttcaagtatggaaaggagctttgccagaatcctcccgtgctaagtgtaagtagagcagttagactttaacatggttgtgtgatagtaatgacattcatatctgactctaggcaaggcatggctggaatgaaaaacattgactgttaagtgttttaaggtgaacttctcagatactagatctcttagctcacatagtggaattttgaggaaagtacagggtttgctcttcatctcctaagaaatgcaatgatgattctttaaagtactgatgggtcagggaggggagaaaaccattaaccgagaattgtataatcagctaaaatattttgcagaaatgaaggcaaaagtaaaatattctcaaatgaaggaaaatgaagggaatttgtcacaagcagactttctctaaaaagaatgttaaaattcttcaggataaagggaaattataccagaaggaaaaatggattttcaggaatgaagcaaaacataaatgtaaatggatacgtaaatataaaagattatttttcctcttgagttctatatgactgttgaaagcaaaaattataaaaacatctgatggggcttccatatatataaatgtaatacatatgccaactaatgacataaaggtcagggagtggggtaggagacagtggtaaatctacacggttgcaaggcttctttctacattttacttgaagtggtgtaatagtaatactaagtagaccgcaaaactttaggtatgtatattataatccatagaattaccaaaaaattaccaagaaatatattaaaactacaatatagaaattaaaatggaatattaaaaatttttcaaataatccacaagaaagcaggaaagtagaaacataaaaacaaaagtatagaggaaaaacagaaaacaaataataaaatggcaagcctaaatccatataattacattaaatgtaaattaaacacagcaattaaaacacagaaattgtcagattggaatttttaaaaagagatctaatacgtgttgtctacgagtaactcactttaaatataaaaatagatataaaaaagatgggaaaaaataccatggaaaaattaatcaaaaaaagctggactggctgtattaatatcagacaaagtagatttcagaacaaagatattactaggaataaagagagatagtacagattgattaaaaagagtcaatgtatcaaaacacaagagttctaaatgtgtatacatctaacaacaaagcttcaaaacacacaaagtaaaaatacacagaagtgaaatgagaaataaagaaatccacaattatattttgaaacatcaatgctaacaaaatcatcaacttggtaagaaactacattctgcccaacaatagcaaacaaaatattctttcataagtgcacatgggacattcaccaagatattctggggcaacacaaatcttaacttgaaaagaactgaaatcttaaaagtacgtgtgtgtatgtgtgtgtgggtgtatggtttttttttttttaagatggagtctcggtcaggcgtggtggctcacacctgtaatctcagcactttgggaggccaaggcgggcggatcatgaggtcaggagttcaagaccagcctgaccaatatggtgaaaccccgtctctactaaaaatacaaaaattagccgggcgtggtggcacgtgcctgtagtcccagctactcggaaggctgaggcaggagaatcacttgaacctgggaggcagaggttgcagtgagccaagatcgcgccactgcactccagcctgggtgacagagcgagactccatctcaaaaaaaaaaaaaaaaaaaaaaaaacagtgctacatggtaactcatatcgttatctcttggtgtgtttttattgtttgacttggcaattttatacatctaaagtatactgctacataatcaacttgactcttatttacaaaggacttcaaagcttagtagtgacttaagcgctattagagaatgtttcggtgcatatttgagtatcagttatgattttcaatggaaataaacccaaaaggcaagtaactgtcattataattctgattattagaatagaacaatagctacatactggacatttcacctcccgtctttagaacccttaggatgcaattatttaattttgaagtataccattttttgtttcatttacagcctgagaatcattatttttttaaaaccttctttcagctcctaatccttgagtgatgagtttggtcatatagatgcttatatcatacagatatttttatatcatatagatattttaaacactgaataacattgcaaaaacctttgaaagcaagatgacacctaagaccaatggcttacatataaggcaaacattatcaaccgtgaattgaatagtaaatgctactcctgtaccaatgaatggtgtcatgcattcaagtaccaggtatggctttttctgctatgacacacaacttcttaggggcagataatcacataacaaaaaacatattatgtaattagcattttcttattaaaaaataaattttaggctgggcatgtcggctgaagtctgtaatcccaacactttgggaggccgaggtagatgaatctcttgagcccaggagttggagaccagtctgggcaacgaagcaagaccctgtctttacaaaaaataaaacatttttaaaaatcacaaataggccaggtgcggtggcttacgcctgtaatcctagcactctgggaagtcgaggggggtggatcacctgaagtcagaagtttgagaccagcctgaccaacatggtgaaaccccgtctctactaagaaatacaaaaattagctggcatgttggctggtgcctgtaatcccagctactcgggaggctgaggcagaagaatcgcttgaacccgggaggcagaggctgcagtgagccgagactgcaccgctgaactccagcctgggctacagagtgagactctggctcaaaaaaataataataataaataaataataaattttataaggaaaaatatccctagtatatttttccccaccaaggtctacctattaatatctcatataactctgtgcttgaaacacaatttgggatatattgccttaaaatttactttgactagcaattcagtgttccttttttaaaaaaatctgtactctggagtaacagtgttctaaaactgttgaagaacattggttcgagaaaaacatttagaaacacaaacccctggaatgtgagatgaaaatccgagctaaagggagaaaaaggacgaaagaaagaaaacacagaaaagaaagaaatacagtcaagtgaaactacgaccacaaagaggaacagatccatctcatttaccattggggtatggacggacgtgcggtgttcgagaagactgttattggtcagagttttgctctagaggacaagtaggactgtaacatctctaggatgggtcacttcccaagccctctattacttaaaaattcaaggaggaaccgatgctggagtacttgtatctcagacttctaatcactgctcctacgcttttccaatattacaacaaaagaccagtagggggagaaaaacgcacagtaccgaacccttatcagtagtaatctcaaaagtcaacagattgatttactctcaagcaaacagacttctaaggtacgcagcaccaagacactaccttgaatcaaatctatagcctatatgacatttctgaagtctctgttggcattacgcgaaaaatcccccacgtcttctgaatagttagaattgaatcctacaagctgcttcgaatcagaattcgatttaaaaaaaaaaatgagggcatagcaaaaggtctccacgaagtgagtcaaaggactgcagagggctgtgacagtgcattccgccttcgggatggtatacaacttaaaccatgtcggcagaagaacgcacagcaacgctttgtaaaaagcattctttctattatagaatccataaccacgctggttagccactgacagcggcggttagccaccgcacctcctctcacccccgaactaatctcgtttcctctatgggtgtaaaagtgaaataacccacttgctcccaatattcctttctatatctctaccccagctcgcctgctgctcgtagaaacaaatatactacacgtacgctgtcctaggatgacacaacaccctcactactgcagaagacggatcattaaacaaacgtcagaagagcagccccaactgtacataaacttcgggcggaaaagcaagacgcaggcgcagtagcacatattgttaccctatttgcccactccctgctcctcctcgcctcaatttcgcttccgcttctttgcgcatctgcttccgggggattgtaggctctgcccctcctcagctcttaccctcttctgccggaggagggggggggccgagggggtggggaagagttcgttgtttgtttacacgatgtgagcggaaaaagagaccaataaagtttattctggaaacaaaaggaaaaaaaaacaggggcgacggagaaaggagtcgggggcgggggcgtgtggcgggggctagcgaggagagggagcgagaagtagaaagcggcagttccggtgccgccgctgcggccgctgaggtgtcgggctgctgctgccgcggccgctgggactggggctggggccgccggcgaggcagggctcgggcccggccgggcagctccggagcggcgggggagaggggccgggaggcgggggccgtgccgcccgctctcctctccctcggcgccgccgccgccgcccgcggggctgggacccgatgcggttagagccgcggagcctggaagagccccgagcgtgagtagagcgcggactggccggtagcgggtgcggtgggaatggggaccgggtgggtgccggagactcccgggcgcgcccgccgtgttgggcggaggctacgggctggtcgtctcccagcgtcggcccgcggcggagttcgcctgcgatcgccgcaccctctccctcgcctgcctctggcctctcctagctgcagaggcgagggctcgccgctccctctcctttctctctggctgccgcctcgctcttcctttgcttctactcccagttttggggacggggcggctggaggttgaggaagtgcgcccagggccgccgccccggccgcggtggctctgtctcccgcgccctgcacgcccacccagcccgcgggtggaggggctgccgcgaggactgcggctcaagggacgcgggcgcgaaaccgcgagcttttcttgaggggctgtcacgcccgaggactccggccccgccagcctggcggccctgcgtttgcctcttactgggtttaaatcgcccggcaggggtatggaaggaacaccgctcccctcacccccgccagctcccctcccacccttcctttcgaggttgttttttccttttagctgagacaaacgcttagatctttcattcatagacctgagacactgactcatgtgacttgtctctttactaagtgtattatgtgatgcctgttccatggctcttaagtggctcggaaaggtagggtagggcccgggattgggctatgtaaacaccagacgttcagccggcgtgtttttgacctcggctcgaggggtttattttaggatgctaaaggaatagtgatggtggccaaccgtgttaccagacttgggaatcgaaagctatttttttatgtcaataattgagactgtttacatggttaaataaagggtagggtaaagggagcgcaacaagagggtctttctagaaaacagtctgcatattctttaatgaattagagttgtgatttcatcttggtgaagcttcctcattccagcactgcgcctttgtgcacatgcaggacctgggttttcggaacgatgttttgaatcatagtttgtgtggccggggagaaccccttagaatacttgggtaggtaaattccaggttatctcaggggattatttctactgcgacttttgaaccactgagggcaatattggtcatatgttatcctgcttagaaattgaatttttctgagtatttgcttacattgcaccgtacaaaatttgtttatgtgctggattgcgtgttttaagaaaacttctggaaaatactcaaaataccgtgttgctaagttagtttggataaatcaaaacactttgctttcaaagcaactacagtcttaacaatttaacgtgtctttgtattcaggttttaagtttttggtgttttttttttttccttttaactgaagcactgaggtccgattgacagcatagatctccatctaaacatcacatgttctggaaatttttaattatcagattaactgttctgcagtgtcatcagccaaaattatctgaagaggactgtgtgtgtttacgtgtgtgtgtgtgtgtgtgtgtgtgtgtgtgttggtattttgcttaagttttttcatctcacattttgggacaaaataaaacttcatagcttttttcaaaagtttcttgtgctttttcaaactagagtactttcctattaaaatcacaaaatagtttatttaaaaatgatagcatatcgtaataatagcatcatgggggaaataacaagaaagtaaaggaatattaatattgcatgattgtgcgtataaagttttaaagacattcctgtcagttttaaataattaaaaatgaaacacctgtaaatatagaagagtgtttttatttaaggttaaaaaaatttaactaaattggttatagcattaaagagatgttactaaatacaaatattgtacttaaactgaaaaatggcttcatggaagtgtaaattgtcatgggccttgatatatttaaaagggagactaaaagtgcagtggttttgcttgctctgtgcgtggaacagcctttctggtggcagagcttccttcctgtcaggataaggtcctctccatcccaaatcagtatccccttaaaaaaccaaagaaaaaacccaaacttataaataatgcacaacataaagtagactgtaataactttttctctaaaccagtttactttgtgtgccgcttcttataagtaccctttactgaataaagagttttaaacagttacgattaccatttaaagggcacttgctctgttgatctgtttatttgaagagaggtaacttaatcccatttgatctcttgagcagctacagtagcattaaaaggatcagttctctattttgttattttatatcttgaattccaagataggggtgattctttaaatgaagtgtttcttaagcattataaaatatttcatctccagtgaaagtatttacaatcttaaaaattattcagctttagaagtatatgtcttagaatatcatggtttacattttattagcacagttatcaaatagtttttcttaagtattaccttgagctatattaacagtgccgtagacagagtggtattactatccctaagaaatggtattctaatctgaagtcagttggcaggtgacagactcattgacaaaaccaacattttccgactcctttcactgtatcatgctgcgtctaatctccagcctgttttttaatagaactgaagaaattagggcccaaggaggcttaattactgaagatctccatttcctatatttgcagtaatatctttatttaatttcctttacatcatgaacagtggttttcaatcctggctacacattagaataatctagggagctttttaaaagtactctggtctcatccccagagatgctcatttaattggtctgagatggatcccagttatctgtgttttgttttgtttgttttgaagttcaccaggaaatgctaatagaaaaggatgtaaagccctggctgtcaaggacctgtatatttggtccttgcttctttctctaggtttatttctcctccctactcctgcagctcccttggtcttttcatactctcctgtgcaaatacagtttgtacttcctgagacatttgaacactccattcttctttaactggttgactcctactcatctttcacatcacctcctttgaaaagtctagcttgagttaggtatccctgcttcctgttcccatagcatcgtgtactcccactgtcatagcattaacctcactgcattgtaattgcctatttctttgtccatatcctctaccaggctgtaaattccatgaggatagggactcctatcttatatactgtacagtagtattcttattgccaagcacagtagcctgtacattacagcacttgactaaacaaataaatatagtagagacagacttctttaaaacatgtagtgattcataagcaccagtttttattcttgccaatttcatttaatatttttggtcactaaaaatgtacaaccctgaaattgccacacatacgaatttcatttggggacagttgagatgttataaattgtatagagtggcattccacctcagacatatacacacacacgcaaaaaatgaagattattatcatatatagtactgcactggaaataaggagacttgaattcttacccctgtttcaccacaaacatttgggcacgtctcaatctctttgggtgtcatgtataatacagagggattgtacgaggtgctctacatggttctcagtgatctagccttaaaattctgtgagtatcaacagtattggctttggaatttgaggcaccatggttcaaaacctagttcttaaacttactggcaggattactttggacagattttcttatctgtaatgggggtgattactattcaacagagttgttgaattaaatgagataatgtagatccaagagagttcttgccctggatcaggtgcttaataaatgttcatttcctttctccttaggaagtgttagatctcatgagtggacttatctgagataacagaaggacacagtttatgtaataaatcctattttccactttgctgactgttagcactgcaggtgtgattagggaccaaaaaacactgtgacatttggtttcagtctctcagaaccccattccactgtcaaacacccaggtgttagtcaacctgcttgggaaataattatgcctggaagtttcaaccaagagagaatagcaagtgccaaactattcacacatatataataatatgcaggagggtacagtctaaactgatgaacttacactgtctccaaagataagtaaaatcagacttcatcattctaaaaaaaggaaacaaaattaaggatgatttataaaagaaaatccaaagattttggtgaagtctctgttcaccaaaccttaaaattcaggagccattatttagtaattttcaggtgatataagaaatataggaaaaattggtcttctggtcaggactaattccagaacataggcacaaataatgttttcaatttcagattagcggttacagatatcagcagactgaagttattgatacctttctctacttgggaactgtgttttaaaatttaatattgtgttatatatatcacctttatttatttggtaatattgaaagtaaacttacacagaatgtaatacaggttggacatccctaatctgaaaatttgaaattttatatgctccaaaatctgaaacttcttgagtgccaacatacggccataagtggaaaattctacacctggcatgtttgctttctggtggtcaaaggtacacaaactttgtttcatgcatataattatttaaaatactgtattaaattaccttcaacctgtgtgtataaggtgtatgtgaaacataaatgaattttatgtttagacttgggtccctagtatgtctcattatgtatatgcaaatattccaaaatctgaaatctgaaatctccagtgttttggataagggatactcaaaacattgctctgcagaagtttcttgttaccagtcttatttttgtataaatcaaatttgcttgcctgagttttcctttaagtttatgtgaaagtgaattttataagtaacttattcgaaagaaatactgtaataaaaattaaaaactgtggatgggggaaactgaagtgttaggatataaaagataaatatgaggcaatatatagttaaagtctgaggattcagcttcaaggctagagatttccatcattcaaaaagattattcagctattggatatactaatattttatcactgtataccttattcacatttaattattatgtgaatcagttgatcctggttaaggactttttaggtgttctttctttccctctctacctatacagtttagggagttttaagttaaaatattccaataaaaagtttgtaagtttgtaataaaagtggtggcttagagctatctttttcttcaaatagttcttaaagtgaaactgtgtctaatacgtattagagagctctggtttagatgcctaaaacgggtcctcctggccagcagacccagtacctgtccctggcctgttaggaaccgggctgcacagctggaggtgagcagtggggccagcattaccacatgtgctctgcctgttgtcggagcagcagcggcactagattctcatagaaggaccaaccctattgtgaactgcacatgcaagggatctaggttgcctgctcctaatgagaatctaatgcctgatgatctgaggtggaacagtttcatccccaaaccatcgcccccacacttccccaatccatggaaaaattgtcttccacgaaactgctccctggtgccaaaaaagttggggaccactggcctaagggactaaattccccttcggactgctactttgtatatgtatatggtgggggacagattgtaacacatttttgtgtctttttctatattgatacaataggaattgtaatgtgttgcttgctaagtaacataatgagataattcaaataatcacaagttgcataaaactaggaaaaaatgtgcacatactaattattattttaaatttatatttaacagaagcataatattttatatttggcctgacaatgtactcatttctcaagcatcactttggtagttagcttgataatttaaattgtactcatttataagaggttgtgttttagcaacttttgtacattattgcgattgttacaaaggggtctttatgatggctagcattgccatttgaaataaattagggatttttaaaaatctataagaattcttacagactatgcttgtcaggtacacttcggattttaagtatttgtatagtaaagccaaggaaatcagtgttgtgatgtgaagaaaaaaactgtatagggatagaatcattttgctctaatcataactctcctaactcaccaggagttagcaaggcttagtggacgaatatgtcttataagtacaacaaaaatataaggcactattatgaagaggattttaggcatatgtttttgaacaggaggagacaatgttgtgtttattgtatcctcagcacatactgtagtgtccaaatgtaggtgatcagtaagcactgatctttgtgacatagaatcatatttagaaataaaaatactttcttatatttctatcaggagccatacgctttatctgaaaagcaggtaaattgctgtgtgccagtcttatttgatcatttattgagcacagatttggccctttgtattcgtgggttttgcctccatgggttccacttaccatggattgaaaatattaggaaaaaaaaggatagttatttctgtactatgcatatacagattttttttggtcattattccctaaacaaaacagtagaacaactatttacataacatttacattgtattaagtattaaaagtaatctagagatgatttaaaatatacaggagtaggttatatgcatctgctaccccattttatataagggacttgaacctctatggattctggtatccacaggggtcctagacccaatctccaattttccatagataccaagggataactgtatataagaaacacttttgtataagttattaactagttgcctatttctattgatatttggagacattttggcaaagattgttaggttacagagaggctgtgtgctgtggtgaaaaaaaattcgatcacgaatcagaaaacacggtttttccattcatctattaactagctgtttggcctaagatcttggcctttcagagcttgtttcttcacctgcaaaatttctaatacaactcccaaatgctgagattcctagtatgttaaagcctgtttttttatttcagggaagagtaagtaaatcactccctagagagaagacagtctagctcagtttgttgtattttcagaagctaagatcattttgtctgcctgtttataaatttgcacatattttaaaggtccttgtgtgaaattctgtggcagagaaaagctgccattggaaaagaatggagtggaaggattttccccccttttttgaaaccgttagtgactttggagaataaattgctacaggtgtggtcaaaattttggttactggcactgggagcaattaaatgactgccagacattgagagtaggtcatctactgcacaccagttgccagggttataaaggccagcagacttgtcacagcacccttaatagccactggccatcatccttacttgttaaagacttctaggaaagtatattccatatttcccttggtaactcatccctctaggtggttttcagaaaatgtgttctaatcttagaaacataaatctgtaggcatggtaagcctcttttttctaggtctatcctcagttgtgcagataagtatgtggaaagataacagaaatcattgtatttgatcagaaagcagtgatgtttatgctattgatttattgtttttttctgttaatattcaaattaccttcaacttttgaatattttttaaccagcacactgctcaggtaatgagatattatttagagttattttgaggatgtactcatttttcaacaagctaagcatatttctgcagcttgtttttctttgagagttcttgcttttccaagttctttttcctgatggacttatggcaggtctagacctgaaagtactattgtatttcaaaacaactgactgcctttagccccacagtgactgaactgtatttttttcttaggaggttaatgtctttggcaagctaaacatccttggaattttttgctaagtcagccactattttgtgaatatagatttatggagtatatcatcaaattcaaagcagcattaatgggaaaatttgcggaaaaaatattgaaattagacactacttacaaactccaatctgaaatgaaaccatacatgacagcagggaaaggaaagaattacattttggaaccctaacttttatgcatataaatatcaatgcatagtaatgtcattttaaagttatatgccttctgaagcttttcttaaaatctaatggctactattatttgcagttgagaccatgataggcagcatcttatggtatttatgaaagtgatatttgtgttcttttttctaactatataccaattgtaaaagttgaacatgactttttcaaagcagtttctatacttgataataacagtggtagtaaaactcagaacagtttaaaatattagtaattttacagtgtagagacttttcttcactagaaatgaccagctttcagatttcttagtgatattatgagactctagatttcttcaaaatcattttgagtaaatctaccagtgtataactgctaaagcacagttaaatgtatcatgctgtggtcttttttgtttgtttgtttggtataaatatcagacatatatgtttgtttactctaaaactaattttttttaccaatcaaaattgaggcacgtaatctgacaatgggacaggatatttgcagtcaggatagtcttagaaaagccacaaaatatggtcgatgtacttagacttctttaattttccttgccttttcctaaatatatctcataatgattaagagcatgttctctagagtcagactatcgagattactagttttgtaactttgggaaagttatttaacctgctaaatattctccgggtaatacgtatttcttcatttgtaaatgaggggtaataactacctacatcacaatgttgtaatgaggattaaataaataatacttgaaagcatttagtaaagtgtgttgtacatagtaagcactcagtaagtatctgtgaactccttgagagtaagaaccatgttacattcatccatttatttgggtgctttaacattatgaagtgaattgaattctgtcccttccaagaatttaccagtggatccgatttctggatagtgggcaataaggttgccttcaaacaagtttagagtagttttcagttctttacaatactgcttgctttttattcgttaaaacttttaaaatttcattctagctctaggaatctgaatgctatttcatacctactcctaagggaagttagcatatggatatttagtttaataggaatgaggaattaatggacagaaggtattaagtaagtgaatgtacaattttcacatctagtctgtgcttcctgtggattgattttccctgtccattcctggaatcttcgaattcccagcacttatcttaatagcactctaccattgaagcagttttgttttgtgctgttagatacttcctttccctgtcttgtctttttttcatgcactaaagacaagagttgtgtcgtattgtcacatagtccttatattacagggcttttaaagaaatctcacgtcctgttttcaagctgcttgtatcttgtttgtccattctacttgctatgaagtctttattgaatataatattaaactcttttgcatatcattgtttgttacctaggacactcaatggacatgtgtaaactttacaagtcatttatgtaaaaataaggaaagcaaccatgtgttttaattatttccatcagttcaatctctaagtctttgcctttaattaccaaacagctatgtggtgccactgatacgagtttctgtggtatcggctacctggttttagtactgttgttactactttatgtaaatgagactattcactcatatttaagtttgtggaaaatgtatatatgttcttgcgttttagcagttttggctagactgctcttgatggtcatgcagggtaacttacttttctaaagttgatgatttcatggtctgtatttctcatataccaggataatagtaaaatctacacactttaaaaaactacatatgttgttgttaacatatatggaggtttcttcagaaattatctgcgatttttgttgtaattgttttcattgttgtgtgcttttaaagaatgacttttattaagcatgcttccaagcttttttgtacatgaaaaactgcatataattttgtctcttttagggggtgatatgtacaatgaaaaaataacatgacattggattgccctggggctgaccaagagtttgtttccatagtaagggattatgactaatttaggcattgaagttaagaatttattacttatttttaaatgacatcacgaagagttacagctgaaacccatggaagaagttttcttgatttttctatatgtacacacaaatgtgtattttgaattcccataaacccaaactttaatataaacctgaggagggggagcattatggactttgtatatgctgcctcccttaatcctcacaataacacttctgatacatgtgtaatcacttcatttccatgattaggaaaatgaagtcccacatcaaattaatacagtagaatctcacctcatttattttacatgaaatcaactgtacctactcagtcaaacataaaaacgtgacaaaaataatacagtcatgtgtagctttacagtggcaatatgttgtgagaaatgcatcattagatgatttcatcattgtgcagacaccacagagtgtaccgacacaaacttagatggtatagcttactaaacacctatgctatctggtacagcctgttactcctgggctacaaacctgtacagtatattactatactgaataccataggaaaatgtaacacagtggtatttgtatatataaatatatctaaacatagaaaaggtacagtaaaatacggtgtaaaaaattttaaaaatggtatgcatgtataaagccttaccgtaagtgaagcttgcaagactagaagttactctgggtgagttggtgagtgagtggtgagtgaatgtgaaggcccacgacattactacacactaccgtagacttgatgaacactgcacccttaggctacactagattttttaaaaagtaaagtaattgcgctacaatgttatgacagctatgatgtcactaaatgatgagagtttgtcagctccattaatcttacgggatcactgttgtatatgtagtccacagttgaccagaacattgttatgtagcacataactaatgtaaatattgcaaatcacatctgactactgagcttttgcttcaaagtagacacttaaagataagaatttgccatcctttcagttggtctcagtgcctaggtctaggtatgttacattttgttgtgttgagtgtgattctgttattcagacatgtaatgttcatacaacatggcctctaatacccagcctgtagtgcccaaccaaagaaacagcagtttgatccggtgctggaagagaaactgctgtttgggcttgctgagcaattgtattggtctccaatgtggcctgcagatatggcaacaagaaactgtcatgtattctctttgatatacacacgtgtgcaccccacatgtaagccttcacccttcttaattctatgtatattttatatattgtgtatatagttctattgttttagattgctatatgtgcattatatctttgtacaacacacaattttgtacagtgtggtatacaaaaaccacatacattatactttatggatgacttgagatttttcaagaaaaatgtcgattctgtacaatcatagactctgtttgtttgcacatactcatttctagaacatggcaccccagaaatacctctttcagttactagctacttagtaccaacttttcaggctcacaaaacagtagtttgttcaatgttacatagtaggcaaattactattatggttctgatctagaattataagcaaacgtgctgtttcattgcatcagaccttcccttcttcctcggtgtaagagagatcaagtcttcttggctcagtagcaatgtcttctgtccagctagcaagaatggcacaggaggctcagggtacacttctcattacaaggccttaagggaagtgctgcttctccacacagagcagataggacaaaaattgggtgtttgcacaaagggagcaatgattccataaggaggtgaaagtaacacatagatttgtcaccttatttacattttctatcttcttgtctctaggcaaagggggtaacagaaacctgcttagtgtttttataaagtaaattctgcctagtatcattgaatttcctttagcacatccatagacatacaacagaacagataggagaaagaaacataaataacaggaagtgctgggcgtggtggctcacgcctgtaattccagcactttgggaggccgaggcgggcagatcacttgaggtcaggagtttaagaccaccctggccaacatggcaaaaccccgtctctaccaaaaatacaaaaaattagctgggcgtggtggcgcgtgcctgtaatcccagctatcgggaggcttaggcagcagaatcgcttaaacccaggagttggaggttgcggtgagctgagatcacgccactgcactccagcctgggtgacagaatgagactctgtctcaaaaagtgataataataaagagataacagaaagtccagtggtcacaggaccagatgttttgagatgcttgtaattccaaatgttccatttccatactgttctaatatgactcaagtaattcatctggggaatgaaacagatttttcaaaagcgccttcagaatttgggctgagaaaatatcactatatgtatatttatatttttttaaaaagctgagtgattaaacattatttcctgtttattcaatataccctataattgacaatgtggtagaccctgggtatataatggtaaacaacacaaacatactctgtgattgtacggtcaacgttttccttgaaaaatctctttaattactcataaagtacaatgtatatagtttttatatatcaccttgtacagaaatatacattttatctctgtataaaacatacagaaatctgaaacatgatgaagttatatatgcaatgtatgcaatacatgtatttaaaagtgtgaatttatgtgtatatatatatgtatcaaagagaatacacatgcacagatgatagtttgttgtggccatattaagccatctttgcattttaaggataatttctacttgtagaaattatctacaagtagataaacacattatctaaacacatgttgtagagtcacactctgccacacccatctaatttttcatatttttggtagagacagggtttcgccatgttgcccaggctggtcttgaactcctgggctcgagcagtctgcctacctcagtctcccaaagtgttgggattacatgcctaagttagacttaatatcatacccggcctggtatgataggatttcattcctaggaaaaccaagagtcaactgagaaattgttagaatgaataagaattctagagtaaatagatgtaaggcaaatatttaaaaatcaatagttcttccttatgatagcagtaattgtttagaaaacgggaaaaaaacccatttagaatagtaacagaaaatataaaattataaatgagccaatgtgaagaaacctaaaaatctacttggatgttggaggttacagggaaaggaatatcatgtttctgaatgggaagtccagcaattacagataccagttttcctcattaaattacaggtttagcctaattctcttctttaaaaaaaaaaaagtgagaaattagcaaggtaatttttaattttgtctgagaaactataaacagataaaagtaaggtatcttttgagtggaaaatgaaggacagagcgctaaccctgtagcttattagctatcaaaatatacaatacaattagagtaaatgaaagagttgaatactggcatacacattgatagtaaaattggtaaaagggaatagagatcccagaaacactctaaatatgataaagaagtaatcagaaattaggagaaaaaggaaaactaagatttgtttttgagagtattaaatacttaggaaaatagacttttgaatctttatttcatcttacataccaaaataaagtctaggtaagttgaagagttaattggaaaagagtaaacttatgcctagtgtcattttaaaaagacatttatgtgaatggggaaatactttccaaagcttcaagaattgtaagtactcaaaaggaggaacaatcattcgttcgactctcaaataagattggggcatggcaatgtgccccctctagtccaagctactcaggagactgaggcaggaagactgcttgacccccggagtttaaatgcagcctgctagcaagactccctatctttaaaaaaacaaaaaaagaaaaaaatctctttctctcacctcctctccccccaacccccatacaagtgaacaaattaaaagatgtgcagaccaggattagagttctgcaaaaattcaatagatgtttgtctttaaatttttactacaaatactttcaaaagcaccatgacccatatggatgaatgagcaaagaatttgagaagttgggctcatttactaaagaggaaatgcaggtacaagcataagggacatgtttttccctgacaggtaattgaagaagtgaaattttaatatgtagtgatttttttttttttactttttgagttagcagaagtatttttctaatgatgtttttgctggtgagggtgccatgcaatgtgcttgtccatttatttccattgacagtctgaattggtttaaccctttcgaaaagcacgtgaacaatttgcatgcctttaaaatcaacatacagtttgacccaataattctctttgcagcattagatataataatttacaacagcttatgtatttaacaactaaactgtttaacatctcccgtggaaataggttgtcatagaaaatgtttatgaagagtttacaataatttgcggaaatgtttttgtagtgaaaaaagatacaaaattatgtatactatatgagtacaagtatacaaaactatagaaaacaaagaaataaaccaaaaatatccagacaaaactgtaagagaatacataaaagatgctaatatggtgtcttaggtacgttttcttttggtttcatcattcatctgtgcaccgctatatttccgatacttacagagcacaatcccaggcccataatagacctttcagtcagtgcttaagtgaataaatttctgtaataaacatgggattcatttacattgaaagaaatatgaatacactttccatccaagttaagaaaaggaaaaatgtgggaagcactctagaaaggaaactgattaataccttacaattagattttgttttcagaatgttttcacatctctattttatgcgatccttttctgttctaatttaataatatcattacttacctaagttagaaatttgtgctaaccggctgggcgtggtgcctcatgcctgtaatcccagcactttgggaggccaaggcgggtggataacctgaggtcaggagttcaagaccaagcctgaccaacatggcaaaaccccgtctctactaaaaaatataaaattagccaggcatggtggcgcatacctgtaattccagctactcagaaggctgaggcagaagaatcacttgaacccaggaggcggaggtagcagtgagccaagattgcgccattgtactccagcctgggcaacaagagtgaaactctgtcttaaaaaaaaaaagaaaaagaaaaaagaaatttctgctaaccttgattctatcccttttgacctgccaaatccaactgattaccaaatcttgggtattctttcttagaaatgtctctggattttagccccatcttttctcataatcactgccttagtttattcctttctcatttcactttactgtccctacctgtccttctacctttctactctcctcttttactttccacactgctgtaaaaattgtcaggtaaatagcagaattttgtgtgtgtgctattataaataggctgtatggaagagactggggggagattaacactgctttcacactgctattacaataatcaccctaaaatacaaaattgatctgcttaaagcttagtaattccttatgacctatattgatgcttctcaaacttgggttgtataagatcacccaggagacttgataatgtgcaaattatccagaccctagaaattctggttgagtggatccatagtactgggaacctgaattttatttttattttaattttttgaaacaagagtctcactgtgacacccaggctggagtgcagtggctgatcataactcactgcagccttgaactcctgggcttaagtagtcctcccacctccacctcccaaagccttaagattgcaggcatgagccactgtgttgagcctggaacctgaattttaataaggcttccctctcatgatccttacgcatatgatcccaggacaagatgttgaagaacagaccttgggataacatgcagtctcattaatttactgtaattctcacaatttggcatcagccttcttttctgtgctcattttctacatttttttctcatggacaccttacagtctagtcactctgaactgctacatgctcacctaggttattgtggacccctgttcttgtgctcatgctgttctgtggttcacagccttttttgctatggcttctcctactcagtaacatgttgatcttggtacactatcttcagcttatatgtaatctgagtaaagtattcccagactcactctcctagacaaagtctatctctccctcttctgtatttccatagcctctattacaacacacatatactaaattacacttcttttcataccttcctcactagaccatgaacctcttgaagtcagggatgccatattttagatcttttatttaatcttagagtaaaagcctggcacaaaataattgcatgctaaatatttgtcaaatcattaacaatccaataaagaaggcaaggagtaattagtcccattttcagtgaggaaaatgatatcttgagaaattaagtatttgcttttaattacccagcttgtaagcgtaggctcaagacttacacataagaaatctggcttcttttctggttttggtctttacagaaaagatagagaataactgtaaaattaccccttccatttttacccacacggctcacatgttcatttaaattaccccctccattttctacccataaagctcacatattagtttatgttttatcattttatgggtaaaggtgttttaataaacttttacatcatattcacactttataaaaataaaataatgcctattcctctagggtatgaacagattgctggatattaagccatttgtctctcactttcacatctaaccttctttactctgctttgtaatgcttatttatttctcttgcagaaagcatgttatagtgccttatgggatgtctacaaatatttgtttaatcaaattgagctaatatttatgtaggaaacattttattctgcaacaattaaggcaaacagatatatgtgtgtaagtattcacatgggtttccactgtagttttgaaagctcagtttccaaagtttagatgtgtttagccttactgtagacttcactcttaaggtgttgatggaaatcaacaaccagctgcaaaattcagatccagtatgccataggatacatgtagccacggtttaaaccaaatgttagcaatgaaatatttagtagcaactgttcttttaaaagaaacattttagataattagagtcgtcttgtaatatcttatacccagctgtcagctttttactttttctgccaatatttctggaactgaaaccaagaaaatggaaattagggcaccacactttgaaatgtattaaacacttgaaaaactgttatatcttataggatttccaaaaagagttcttcagtgcctcagaagatttttataaaaagcaattatctacaataaccctccccagtattaagctgaaatatacacataccttagtaaataataggagcatttgggaagtggaagaattgcctcttaatagctactggacttgaagattattaaatttgagcattctaattccatttttgaaagtttctgatattgtttcttaattttgttaccatgtttaatcagtatctcactagcctttcattcatttctttagcttctgttactatctttctacttttaagatactcatatcttcattttctgccacatcaactttcagtaatattcctgattcctcactatgttagacagtgataatagtgtctcattcttcctttcaagtctttcccacccttctacaaaatgttatatataattactttttaaattgtcaagtattgataacatttgcattctgttctataaccatatttaaatcctctttctttttaactatagatagattgtaatagttgaacctagtactatttacattaatattatataaaaatgtttcactttacaaccaagtagagtgctacagttggatttctttctctgaatctgtgtccagcatcatgaactacgcaatgaatattctttgcattcagatcatatggtttatcttttcatatattccacatactgctcaaaattgtgctcttttgcttcatttttagcatgatgttatacattttttgttttcccctaaagtttccaattacttttcttttttctattgtgaaaaccataaaaacggtattcagcgtgccattagtgctgctggactcctcagttcttcatctgttgcttcaaacctgttgtattgtttttcctgaatactttttactctggaattcagatttcatcttcaagtttgggcatattactttctgtaattaaagtttatctcaggactgctttttcttaatgatttgtttacgttatttgaccactggttcagttccaccatttctagcatgtggtctcttcctctttcttgacctccacctttggttggctagagtaattaatcaattaagtgccttagaattggttcaggggaagtaaaactttggaaaactaattgtctgaaaagacttttattttttctttacacatgatagtttgctgagtatagaattcctggtcaaattgttttccagcattttaattactgcattgttttttacttgttattgatgagaatagcattgccagtcagataatttttcttttgcagattacttgtttttccatctctgaaagcttttaagcttttatctctatcttttattgtctagtatagttctttacatttattctgcccactggtcccttttaatctaaacatgtaagtctctccagctcccagatgtttttcttttatatctttaatttcctttcttccatttttctcttacctcagaacttgtgcaataaggaagtattcagttgttgaacctctttgatttattgtatatctttttcacccttgtttcattatgtctgtctttttgctctatgttctagcaattttttaaattttgcaaatataggtgaaatgttatatccttatgattttatttttatattgtgtttgttattctattaagattcatttcaatataaggtataaattggaaacccactcttttttcccaaatgtctagccgtttccaggtggtctcttccctattgatttgaaatgatacctttatcatgtaacacattctgtgtctatttttttaatttctgggttttttttccttttgtctggctctttatgagccgtatcttaccattgtgattattgtagtttcataatttttttttctagagaagagaaggtttggttaaacttttgagatgtttatttattttcccacgtcaacaatcatggactatcatgttatgtttatgagtggctgagtcatatctcctgaggaaaacatagcaccattgagtgctacagcatcctatagagaacttcagtttttggtcatactgttaagacctcttggtttcacagccccacaagccctctttgaagtgacctatccagtagggctagacctttctctccccctgccttctcccctcccctaatttttctggtctcctgcaatttttttttaaacattagaatcagcatgcttaattctacacacaaacacaaaaatcctattggcattttattgggattacatcatatgtgtagattatctaaggaagaattgacattttgggaattggttgtcttcctatccgagaatgtggaatgtttttccatgtcttcaatcttttgtgttacttgggagcattttaaagttttcttcgtttattttaaagcagttaaaattcattttttttcagttcacgtgactaatcaattctaccaggaccgtctattaaataatctgtcctaattaaggttctggggtttttccctatacaaaattgcagcaactattgtacttaagtttgtttctgaactcagttctgttctctggatctgcatgggccaatactattctatttttataactaaggatttaatacctacttaggctagccccttctcattactcttctttcaaacattcagtatattaaaagctgttataatacttcttactctgttttagaggtggacatagacattacacacatacaaaaaaactgcaagccaatctcacttaaagtattagttatcttaaataaaatattagcagattcagtagtttgttaaaacacacacacataccatagccaaatggcatttattctggaaatacaaaggtcattttaatcttaggaaatctgtaacagacattaattctctctctttccctgcctcccttcctccctccctcttcctttctccagcacagacatgcacatgcgcgtgcacacgcgcgcgcgcacacacacacacacacacacacgaccttagtaaaatagggatagaaagctattctttgacgtactaagtaatagatataccaaactagaagcttcagtcaggcttaataatgaaagactcgcattgtcattcatattacgaataattcaagaaacaatcaatagctatttttttgccttgcttttgtaagggaaaaaagtaatataaaggagaagacatattcgcaaattttaatttcctgtatcagtttctcctgaccactcactcacattctccccaaagtgaagccaatgttggtaacggagtgaattctagtgggggacattggaggggatatagaaatacgtttgttcatatatgctttttaacacagatttttaattgtattagtataaaagtgtgataaacatgctttcattttaaatatcttctgaacctataaattatattccccttttaaatttttgtttaatttttatcatcaaaataaatgtatcttccagtaaggacagtgtgaggaggttggatgatttccttcttcagaaaacaggcatcaaaatactggagtaactgtgttaatgtcagccaaaatagattgtaagaaaaggagtattattagagataaagaggaacatttcaaaattatgaagtgacaaatatggcaggaaaatataaaaattctaaatgtatatgcacttaagagaggcacaaaatgcatgaaacaaagattgatagaactgagagatgaaataggcaattcaatatttagaagagttggagattttaatactcttctctcaacagttgataggataagtaaacagaaaacaggatacagaagacaggaataaagcaatcagccaactcaatctaattgacatctgcagaatacccaacaacagtagaaaacacattattctaaagtgcattggtaacattagccagggtgaatagtatactggcccacaaaaatgaaatgttttaataaatatggaagaattgaaattatatggtatgttttgcaactacaaaggaattaaaaatcatggagagaaataaggaagaaataagtaaaatccccaaatatgtgcaaatgaatactatttctgagtaacccatgggtgaaaaaagaattcactgggcaaaatagaaaatatttttaactgagtgaaaatgaacacaaaatgtaagaaaatatttggtatgtagctctcaggcagtgctaagaaagaaatgtttggctttaaatgcttatgccagaaaggaagaaaggttaaaaagtcaattatctaagctactaccttaagaagctagaaaagaaagagtaaagtgtaccaaagtaagtagaagaaagggagtaataaagatcagaacagaaatcaaggaaatcaaaagctggttctttaaagagttcagtaaatctttagctaaaatgaacaagaagggatgtaaattagaaatactgagaatgaaagaatgggtattactacagatactataaatactaaaaagataaaggaatattatgaacaagtttacaacaaccaatttggcaacttagatgaaatgaacaaattctttgaaagatactaattaccaaaactgactccaaaagaagtagaaaatctaaatagacctatatagagtaaataaattgaattagtagtttaaaacttccaataaagaaaatctgggctttaatggcatagctagtaattctgtcagacaccaaaggaagaaaaaaatacaagtcccaaccacattttcagaaaagcaggagggaggagagcatcacaattcattttatgaggacagtattactagataccaaagccaacacaaaggcatcccaagaaaagaaaactagcagccagtattcctcataaatgtagacacaaaaatccttagcaaaatattagcatgtttaattagcaatattatatttaaaaggataatactataatcatggtcaagtaggatttatcccagcaatgcaaggctcacttaacttagaaatatcaattctgtgtaatataccatactaataagatatatttgaaaaaaaagtgatcatctcaatagatgcagaaaagtatttgacaaaattcaatacaaattataataaaaactcttagcaagctaggaattgaaggcaacttcctcaacctgataaagaatgtctgtgaaaaaaaaaatcatacttcatggtgaatgattttatagttttccacttaagatgaagaacaaggcaaggatgtttgctcttactgcttttattcagcattatcctggaggtcctagctaatgcagtaaggcaagaaaaagaaatttaaaggatatttggaatggaaaggaagaagtaaaaccaaatagatggcatttatacagaaagttctaaagaatctaccaaaaagaaaaaaaaaaaatactagaactaacaagtgacttaggcaaggctgtagagtaaaagataacaaacaggaattaattatatttctaaacactagcaatgaaccatccaaaaatgaaattaaaaaaccatttacagtagtattgcatagctaaatacttagtaataagaatagatacacaaacctgtacactgaacactacaaaatattgttgatggaagttaaagaagaactaagttaattgagaggtacactatattcatgaattggtacactatgttcagtgcagtcccagtcaaaatcttgtcagattttctcatagaaattgacaggctggttttaaaatttatatggaagtgcaaaaaacataaccacacataaaaactataaaatctgaacacttacaagtacctgatttgtacttgctataaagctacaataatcaaaatagtacagtattagcataaggatagacatatagatggatgaaagagatttgaaaatctagaaagagtaattcttaatatagtaatatttttcaattaatttcttattttggacaattggtatatcctatagatctttttcccgtgatttaatgaaatgtaacatttataataattttctttttattgaacatttttgctttgtatattatatgttaccttatttgttaataaaaacacataaataaacttggttaggtattatttatgtggtaactgattttcaacaaaggtgccaaggtaattcaatgggaaaagaatagtcttttcaaaaaaaagaaaggccgggcgcggtagctcacgcctgtaatcccagcactttgggaggctgaggcgggttgatcacgaggtcaggagatcgagaccatcctggctaacacacagtgaaaccccgtctctgctaaaaatacaaaaaaaaaaaaaaaaaaaaaaaacttagccaggtgtggtggcgggcgcctgtagtcccagctactcgggaggctgaggcaggggaatggcaggaatccgggaggcggagcttgcagtgagcctatatcgtgccactgcactccagcctgggtgacagagggagactccatctcaaaaaaaaaagtgctagaataacaaaaaatttattaaaaatggattgatggttcatagacctaaacttcagttcttaccccagtaattacctacgtggtgtattgacaacaaaggaagaaaacttgtagaggtgggttttggcagtgtttttttgtttttgtttagaggtggagtttcactcttgttgcccaggctagagtgcaatggcacaatctcggcacactgcaacctccgcctccctggttcaagtgattcttctgcctcagcctcccaagtagctgggattacaggcccctgccaccacacctggctaattttttgtatttttagtagagacagggtttcgctatattggccaggctggtctcaaactcctgacctcaggtgatccacccgcctcggcctcccgaagtgctgggattacaggcgtgacccattgcgcccggcccggaagtgttttaaaacttggttgtagtggtggtttttacaactatacattcaccaagactcatcaaactgaattttaatttatacctcaggtaaagctaaaataaagtaatacatgcatattattttcaaattacaactgaaaggttaataaaaacatcaggccgagcatggtggctcatgcctgtaatcccagcactttgggaggctgaggtgggcgggtcatgaggtcaggagttcgagaccagcctggccaacacagcgaaaccctgtctctactaaaaatacaaaaaaattagctgggcatggtggcaagcacctgtaatcccagctctcgggaggctaaggcaggagaatagcttgaacctgggaggcggaggttgcagtgagccgagattgtgccactgcactctctagcctgagcagcagagctagactccatctcagaaacaaacaaaacatcagttcattactgtatctcacttcccccccattccctctcacaactttgtcttgtctcatgtcatgcttcaggaaaccactttcaactatttaagctactacttctggtatttgccaccttataataatggggtatattgctctgtcttggtccaccaatatttgacattattcattagttttctcttataattttaatgctcatatcttcctttgccttatctcatcatcctatatttaatcattactggttaaatccacatttagttatttcattattcaatgaccatatagtaataaagcaaatgctacatggggttatattttttctgttacaactttcttgttgttttttaattaattgcttcatctcagaaatctgcttagttaccattgtgtctgaatttgtctttccatgggcttcaatccatctttgcaataactctcacatgtgataattagtttggttattttcctataatatccttcatagagccttcagtatttctgatttaatcttgattgcttgctaggtctgtttcacagctgttatctcaagactcttttttgtcttcatcctggaaattccctacacctgcttcctgtgttgaagcattgattcctcctatgccccataccttcatggttgactacctcattctataggagcttatcctctcgtggcatcttgaagagagataactgggaggtaatttttttgagattttacatacctgaatatgtgttattctactcctacaattatgtgatattttaagtgagtgtagaatgctagattgaaaatcatttttacccagatattgctctggtatcttccagctttcaattttgctagagttctaagtgccactctgtttcctgattttttatttattcttttttctctctgtctggaagtgattaatctcttctcttcattttatggtatggtaccttggtgtgcatcgtttatctgttgtgctgtgtactccgtaagtccctgctgcttgcagacttacattcttctcggaagtatccttgccttttttggtagttccctctcctttgttttcattattctctctggaactcctactagccagatactacacttcctagattgtttttctaaatttttaccattccctcctcttactcatccctttctttttattctgccttctggaaaattgccttaactttaacttcaaacatttgttgattttttttttttttcagttcttattctctggtcttattggttcctctgcataaggatgcagtcttttatctttacagtttctttgacattttcctctgtcccatcattctctgtttctcaccacttctgtttcattttggtctcaatctttaatattggagacattcctcaaatgcatgaagatcctcagtggtcatttatatttaaaagatgtgaaaagctgaccgaaagctctgggtgtgaagtcagagctcttgtctattggtaaactatgctgtaggaaatcttcatatcacaatttttctttaggttagttttgttttctctagttttgaatcctttccagaggaaatctatagtcttctctgtgggggctgcttatgttttagagaaatactgaagaaagggactttgggtctctttagagttgcacataatcttctggttttagtcatatctacttctgtatctattgaagtccaaagcatcttgagtttagtttttccagaaattatgccttctgatttctgcatgattgggaagtcactgagtacaccaactggagttggagacctggaattccagtagttccaggaacctcctagtcctgaacttaatggggtttcatgagaattgactggcttctttaggcacttaaatttaacattcctcacctctggtgaggtttttgtttgttgtttgttttttctccctgtctttgtatattatggtttagggttacagttttccagcttcatcaaaaaaagagtttttctcattctccttgtttagaaatgattggtgacacaaaggtctgtactctgatattttaagatccgaagtgtattctaccccttttttataaactattttgcagctgttccttcacgactttgctacatcttggagatcttttcatgtcagtacctacaagtctatatcattgatattatcagctatatagtactccataaaatgctttattataatttatgtaatcatcttcctattgatgaagattttggtggtttctagtttttgctttcatgaatattgttgcaatgaatattgtttggcttacttttgggtgaatttttacaaagacatccatataataagttcccagtagtggggttgcctaatctaagaataagtgtatttaaaatttgaatcatattgtcagactgtctcccagaaagtttacattcctaccaacaatctgagagagctgtctttgcagttactaggtttcatcaaacttgtttttttcagtatggtaggtttaaaaatggggatacatttttgtttttatttgcatttttaaatattttcttaggttagttggctacttaaatttctttttctgaaaactttgtatttatagccttttaaaattcttattgacttgcctgaactatttgtaaattacagaaattagccctttgtcgtatgtgttgcaggtgcttttccagtttgccagtggtcattcattttggtttatggtacttttgatagaccagaatctttgacttttatttagtgagatttatccatctttttctgtgtggcatcttggtattatagcattaatattctcttttcttttttttttttttttttgagatggagtctcactctgtcgcccaggctggcgtgcagtggcctggtctccactcactgcaacctccgcctcctcgtttcaagtgattctcctgcctcagcctcctgagtagctgggattacaggcatctgccaccacacccagctaatttttgaatttttagtagagatggggtttcatcatgttggtcaggctggtctcaaactcctgatctcaggtgatccgcccgccttggcctcccaaagtgctggaattacaggcatgagccaccacgcccaggctatagtttttctttatctgaacaataactaattataaagtatagtggaagagaaaaacccattcagaaaattaacaaaaagatcacttatctagaaataaacttaaaccatagcagagcttacatgaagaaatcttttaaaactgagcaaggatttgttggacaggacacagcactaatctcaaaagaaaatttgatgaataggtcttattcatagtttttgctcatcaaaagacagcattaagaaaatgaatagacaagccacagaatgagttaaaaaaacagaaattcccagcatttacaagggattaaagatgtgtatcagaatatataaagaacctctgaaggccaggtgtggtggtttacacctttaatcccagtgctctgggaggccaaggtgggaggatcatttaaagctaggagttcaagaccagcctggtaacatagtgaaacaagattctgtctttacaaaaaaaaaaaaaaaaaagtgtttgggtttttttttgtgtttttttttttttgaagttagctaggcatggaggcatgtgcctatagtcccagctattcaggagcttgaggctgtagtaagctatgatcatgccactgcactccagcctgggtgaccaagtgcgaccttgtctctaaagatcaaaaaaaaaaaaaaaaaaactcagaaattaacatttaaaaaattatgaactacttaatataaaaatgggcaaaagactcgagcagacatttcacagaagatatacaaatggccaataagcacatgaaaagatttccaccatcattattagtcatcagtaaatgcaaattaaaaccatgataagataccactacaaattcaaaccatcatgagatacccactagaatagctgaaataaaagtgactgatactactgaatagttatgatatagaccaactggaattctaacttattgctggtgggaatataagaactatttcttataaagttaaacataacatttacctaatgtgtcaggaggttcccagaatcatccctaggttccatggttcgctaggacaactcacaggactcagcatgatgtcgtactcatggctctatcacttactacaatgaaaagacacaaagcacagtcagcaaagggaaaaggtgaatggggcaaaatccaggggagaccaggtacaagcttccaacaatcctcttccgtagagtctcacaagacacacttaattcccccagcaaagagctgtgacaatacttgtgaaatctaaccagccagggaagttcgctacagattcagtgcccagggcttttaccggggtctgatcataccctctgctcagcgcacacccaaattccagactcccaaaggaaagcaggtattaagcataaaccatattgttatcataaatgctttagacacatggagccagtcttatcagatgggaatcagggtaggaatcctcctaaaatccaagatccaagttcccagacaccaagccagccttgcaaacaggcttttttaaggataagcataagaatattaactcttttctgcaagtttacaacctagcattttgctaagtataacaaaaattgatgtaggaattttgatagccgatgctggaaacagcccacatattcaacaactggaaattgtataaacaagctgtagtatattttggaatactacttaaaaagaactaaccactaatacattaaaacattgatgaatcccaacctgttgcactcttctcattctgtacctgacagtatgttaaccaaaagaagccaaatacaagagtatacactgtgattcaatttatgtaaagttaagactcagcaaaactaatctataattacagaaaccaaaatgtgattgcctgggggcagagagagaaattaattggaaaagagcatgacagaatgttctaggataatagaaatgtatattatatatcttgttttgtgcagtggttacgtgggtgtaagaagttgtcaaaagtcatcaaacttaatgcttaagatgtgcagagttcgttgtatgttaactatagttcaatttgaaaaattaactactgagaaacattgaaatccaatgacattcctatccaaatacatatttggataggaaaaacatcttgtaaagatgtcagttctccctgttctcaaaataacaagaagttttgccttgatttttgtttttgaatttagcaaaatattcaaaagttcatctggaattatcagccaagtttaataagactgtgaagggactttacagaagctacttgggctgaatttaaaggatgagtatgattaaaatggcaataaatgtgaatatgaggtaaaagattatggagcatatttacaaaggcaaaaaactgtaaagggaaaagattgatctagtaagattagagcttggagtgtgggaaaaataagagaagagcacagttgtaatgtttgaggcttgagtcaaggctgtattgcatagttactagagatccacaatattgtcttaattgagtaatggtgtaattagatatatgtttttagatagccaattctagtgacactgtagataatgaagtgggtggggagaaattggatactttgtgctttcagggcctcttgtcttagttcatactgtctacttaacctgttgcactcttctcattctgtacctgtcagaaatcaggcccactttctcctaaaattaccacgttctgccttgtagattgttagataataaggtcttttcaacctcatttatatacttcatttatatacttgtatgagtgtttttctcctcctttcctttccatcacccatccctttgcttcagctgctagtgtcttaatagaaggtaattgcttaatgaatgcttgttgaattagagacagatcagtcctgcatatgagaactcttttagggtctaatagtgatagagaagattgaaaaaaaaaggtgatgaatttgagggtaatttaaggggtggaagtgatgtcatgcaagagaggagttgaaagcaccaaatgttttaaccttggagattgagaaagtggtgatgtcatgaagaatgtattccacatttgaataatgagcagagtaagaggtaccaacaaatgaaacaattaaaggaggccataaaaacaacagagatcatttcaacattctattgaggaaatttggggggacacactttaattaaataataacatcagtatttctttacctttgtaacttttaattaatgaagatgttttaagatgaaatataaaatgtgaacctgagaactgtttaacatttaacattatggatatacatatccatgtttagaatgttctctgtgtattaatgcatgattttgtcataaataccccactaggaagagaaaggtcggagagagtgtgtgtgtctctatgtgtgtgtatttgtgtgttttgtcctggcaaaaagacaaactgagagaacagaagaacaaaagagcagtactgaaaatagctagattaaaggttgtttttctgtcaccacacaccagatatggagagtagtaaaagcagacagatggacagttctgttagttttggagtgtgtgaatagagaaaagaaacattctgttccttttattcagaaaaggaatttctagactaaattactggtatcagcaataagtttcatattctgaccaaagaaacattattttttttttaccctagggataatgactcatgctgttctcagaattttgcttttgtggaaactaaagtgcagtcataaatacggcactgttatttagatcttagtgctaatgatactattgtgagtagactagtgatgggtaagaacactagtattataaacccagttgtaacaaagaaaccaagcacatcttaattagctgattctagatgggaaagtagattttttaaacaaattaactaattgttttaattctgtgaattatgcaatagaaataggacccataattttatttttttaatacttcattattttgaggggtttatgtcagaagttaaatttctaacttccaatattgacagtggagataattaaacatattttctctgccttttttccttatgttcctcaaaattagtataagtctactaaatcatagtcacatacaccataaagcacctatcaaaagagtatcagctaggtgaagttcaaagattatattctagttttattttaacctttaaagtcttgtaatttaagaaatagaggtttgaatgtcttctttatataccatagtactagatgctctcactctgaatttttaccatgtcaggatactccatcacatatttatctctgtaattataattattgggcacatacacaaaagagttgtcctttacggtatctctgtccaacctaaaaactttcccatttctcttcactttaatctcttcagtcgttccctttcctgaattacctctttactccctagtgacggcttaaagttttagatcttaaagttccctttttcaaactttcttacgtcttcctctgtgcctttattttaatgtcagcagaagttagctcatgaatcataacatgtgaagcagttgtttggaataattgacagcttttaatgacttatgttaaatagccagtttaaaagtttttgtcagttgataagctttataaagaagcattttaatgtattaaatcattgtaagtaatttattgtttaactgcatgccttgggtggttaactaatgtcatacagagcatcagtgaataagagtggcagtattggctgggtgctatgactcatgcctctaatcccagcactttgaaagtcagaggcagaaagatcaccagagcccaggagttcaagatcagcctgggcaacatggcgagaccccatctctgcattaaaaaaaatttagctgggcatggtagcacacacaggtagtcctagttcctagctactcgtgaagctgaggcaggagaattgcttgagcctggggttggggctgtagtgagccgtgttcgtagcactgtactccagcctggataactgagagagaccctgtctcaaaaaaaaagggtaatattctactcactgatcatgtatgttgctgcttttacacagttatacccatttcagtttgtcattctcattgcttgctttttaaggtatagtaattataatttccaagatacttggtacattgaactgtacataagtataaataaatagtaaatgcttgaaagggaaaataaagaccacttactaatatttctctcccaccattgaagtattttggctgtattgtattatcgaaaagatggattttttagaaatctgtgcttacatgacttcacattgttgttgctttcattcatagaacttgtcttcacatcttagctaggtgacacttgtgctgaaattaagctaccctctctctgattgcacttctgggagatctgagtttctttgcttgccaaagttattacttcaagctttcctgttgtgaaatagcccttttgccagagatcaaatactgaaggatgataaatcactattagtcaataattgcttgcaatggacattttcattattactaacataatactaggatattttgttattgccagaaaatggggcagatggcaaccaattacatcaggatataaagttattgtttggtctttatcatggaaaaagcattgttatttaaatcaaatttttactgtatatcatgtctttcatccaatgtcgtaacatcccagatagacttggggtgtattcacttaaaaaaatacaatatcttacgttcattagagtatagttggaagaaaatgtattatttttgcaagaagctgtttatggatttatctgattaatttatgtagagccaggaaaaagttgttttgaccaataaatttggcatttgaaatgagcaggttaagaatagacattaagtgatcaccttaagtgcaataaaatttcagtgcactatacattctgtgctttatatctatttgtaagaataccaataatatatcaatatggtataagaggaaagaataagagattactataatagctcctaagaaaggaaatcagtccaaggacataggctgaggttgtgatgtggacaaaaagataatagcaaggatagataaataactagacaaaaatgtcagggacctaagtatttatatggcaaacaaggatactcagtacatctagagccagactttttccagtgtctaatccttgttgtatattaaatactttgggaactaaaatatgttttatgacactgtgttaactgatgcataattatgtaatggaagccattagggcctgtgtcttggcaggaattaaactaaaagcaaggtccttctagtatttttggtagaagattattggctagtgcctattttcacagcacatactactaaaattaggaggacgacagaagacgagcattgcccctccctgtgcaaaattgatagacacattcaagaagtattccatatttttaagctaatctttttatttgattcacttaccagcaggctgttttcctgctgcaaagcaaattggtggagtccatttacaccttctccttagcctataagtattggcagaatcaccaccacgatcacagcagcacagtccagacagtgtcatttgattttgaaaatattgtccttgcaacagccagctaggacaatgacatactaatatctgctttgcttattatttgtgcctgggagtatgtaatcatagtcaacagacaccatagctacagttttatgacacttggtctcaggaaatagagaactctacagaagacagtagaccatgatgaagctttatcattagtccctggttctctcccctccagatcactttggccttctgacagacagtacagataaatctgttaagtttggaatgttgaattggtcaaaaatgaaaataatagtccaaagcaaaaagaccttctgtgaaacatatgtggatgcaattaggtgaatatattgtatctgctggtgtccccaaagttgatagctttatttattggaccagcctagactgaaaatcttctgtttaggcattttggtggggattttttcccctctgtggataccgactgttatatttaaggaagatagaacaattggttctaccaagaaacctgtagctaacccaagtttcactttatgatggcagcactttaaaagtttggtatgaaagactcatctcttcttcattctcaagacaatagggctaatcagtgagatgcaggcaagttttaatttatctaaatactaaagagtatcactagaagggatagtacttgaatacaagtccctatggtgactaaattatgtcctcaccccatgatataaggaaataagctagccgttgatttttgatgaagaaagactgtgggaacagtgtgtagcaactgttttccaagaagttatccactctcacccatagtagtggaaagacttgaaagaaagttgttgaggtgttcagagccacagaaaggcctattaagtcattgagctatactagaaagaaacataaaaacaaaagagcagaagccatttgataaacttcaggggggagaagttctaatccctgatgacttacagaaacatcttgccttcagcttcttacagatctttaaaagaatcaggtcaagtgatttgaaagacatattgctaatattacctttttctagattctgtagaaataaaccatttttcctctgctctcacactacaataatcaacacagaagacttctgtaactgctggtcgccaagaagtatatggggatttctccccaccaacaatcagtcagttgattctgccgcagattcttcaatagacagcagttgagtatcctgtaattcaattcagttctgacactatctgcctagagatagcatcagatcccatagattgagggctcagtcacaagactgccatccatttccaatggcagtcataagcttcaggttgttttacttgtgcttctgactgactggctataaatcagcgttcccatgaccccctccttgggtttgattaatttgatagagcagctcatagaactcagggaaatacatttctcggtttattataaagaatactacaaaggatatagatgaagaagatgcatagggcagggcttgtgggaaggggtgtggagcttctgtgccctctgtggacacaccaccttccaggaacctccacttgttcagctatccagaaggtcctcgaactcagtcctttttggatttttatggaaacttcattaagtagcatgattgattaaataattggccattggtgatcagcttaaccttcagcccctctctcctctgaggaggtgggtagggggtggaggtaggggtaggactaaaagccccagttctttaatcttgccttggtttttctggtgaccagccctcatcctgaagcaacctaggggctgccagccaccagtcaactcattagcatacagaaagacccttaccactttggagattccaaggaatttaggagctgtgtgccaggagagaggacagagactaaatatgtatttcacaatatcacatagatgttcttaatttaattaagatgttaatctagatattcttaaactcttaatgaactcaacaagctgagccctggataatgtacccttttgtttctttctttagctcacaagaagccaggaaacaactattttataagtcagccaagtccagaatggtgttagcttcattatggcaagaaagagtgaagttacttttcgtgaagccctgggctttttgaagaaaaagagaggagaggtggttttaacattgactttaagttgaaaagtagagcccttttatacttttttctttaataaatccatcaatcaagaatggaacaatgtgtggttagcatcatctttgaagttccaagtcacaaagggattttcttcctgaagtatgtgggatgtgagtcatttgtaaatgggaattacgaaggacaatgagccctattttttttggttatcatcaatataggtttggttataaacttgttgtaaagagttaaaccatcaggaccttttctcttagagttccacaggagctgaaatgtttgcttagtaggaaatcgcagtaacatttcaagaacccttccgtattttgcatttcctttatattagaccatgattccttgctaagttggtctcttcattgatctcattggttaaattttcattgaggcaaccaggtgcatagacttctattttcactgtcttcagtatatacagttggtcctgaaatggatatacagctggcaaacttaaataccttaggattgtttctctctttatgcaaaagatgctattttttagtcattttataagggaagtgttttttttttcctaatttaaaaaattaccctctatatgataaccaaatttcctttaagtgttgcttcagtgaaccaaatagtgttttactaagtgtaggagttctagctagataatatctaccatctctttacaacaagcctgaaacagtaagttctgtttccctttctggacacatgcatttagataacattgatccagtagataagagaaagggaggccgggtgcggtggctcacacctgtaatcccagcactttgggaggccgaggtgggcggatcacgaggtcaggagatcgagaccatcctggctaacacggtgaaaccccgtctctactaaaaatacaaaaaaattagctgggcgtggtggcgggcgcctgtagtcccagctactcaggaggctgaggcaggagaattgcttgaacccgggaggtggaggttgcagtgagccgagatcgcgccactgcactccagcctgggcaacagagcaagactccgcctcaaaaaaaaaaaaaaaaaaaagagagaaacggatcctttattgaatttctgtgttccaagcactatgctgagaactttacatataccatctcatttaattcttttgtttgtttttctttgggatggagtcttgctctgtcgcccagggtggagtgcagtggcaccatctcggctcactgcaacctccacctcccgggttcaagctattctcctgcctcagtcgcccgagtagctgggactacaggcgcccgccaccatgcctggctaattttttgtatttttagtagagatggggtttcaccatgttggccaggctggtctcgatctcctgaccttgtgatccgcccgcctcggcctcccaaaatgctgggattataggcatgagccaccatgcccgaccctcatttaattcttataacattactgtgagatagtaactatttttattcaccttttgcaaataaggaaactgccttcaaatgagcctacaaagaagacttaagaattggagagttctccctagggtcagtggaattcaggatgatggtgcactgatctcaactaaaacgaaactactggttggaccatttcttctcaggactagattgtgttaatacacattcttctctttgctactatatgttaaataatctggagatttccataatgtttccaggttccttggttactcatttgctacaggtgttgctaaagatgtgtaaaagctcaagtcactagttaggctctctttgtggtttgattagcttttgtccttttctttggccaggagacactctaattctgtccacctgtcttaccagtgcatgccattggtcacaaggtgggttggttaatataaaggaataaatgaattggagaccaagtattgtactactggaaaaacaaaggcaaatgttagtatatttttttccatttggaatagtagtcattcttttagttctgtattttgaaatcattatttaccaatacagtcttcttgatgtgaaaatgcaaacagagttttcagtgttacctgatttagggtcactggaactgagagtgatggtttacttctgactgcctgctgctgcttttatgtgaaactgtgataatctgccttgactcccttcctcctaggaaagaaagaaataaaataattaaataagaaaaatatttagtagaaaactctttatcactgtggaatcatttgtatcctattaaatggtatattatgaaatatatatcgttttccacattaagtacatttgccttttctcataatcctatctcaccttcacctttattaatgtttagtcacattttgagcttatattttaagaaactttaatttgtccttttgcatgctgaaatttgaatttttaaaattcaagtatgctgggcacagtggctcacacctgtaatcccaggactttgggagaatgaggtgggcagatcacttgaggtcaggagttcaagaccagcctggccaacatggcaaaaccccatctctactaaaaatacaaaaaagttagctgggcatggtagcacatgcttgtagtcccagctactcgggaggctgaggcaggagaattgctcgaacctcgtaaacagaggttgcagtgagccgaaatcatgccactgcactccagcctgcgtgacacagcaagactccatctcaaaaaaaaagtaaaaataaaaaaataaaattcaaattgaaaaagttcattttcacgattaaattcatatttacagtgctgccaaacttaaataccttaggattgtttctctcttcatgtaaaagatacataaagtgactacacatttcagtatctggtatggtttctctttataaaatacaaaatttaaagttcatgctttatctaataatctaagatccaagtattaatctatacttcattaatggttctttaccacatttgattctgctattcaaactggattcttttaacccaaccttggtcacatttactgataatcagaagtccacattgctataaatactactcacctaagccttgattatttgtcattaaaaaaaaaatgtgttagcacagatcctctctaaacccattcatgggcctcatattaggaaacccttgtcttatataatgcattaaatctctgaaatatatttttataacatgtttcttagcactgtaaatatgaatttgataatgaaaatgaattgcagttcctcactaaaggaatttaaattttttgcatactagtgatgaggacttgattttccaccctgaagttgtaaaggtctttcagtctctctaaaagtgtgagttaaatctgttttctcacggccagcttttaaaggtcagtgaaggacggcactttgaaagaaatggataatatgcatccttccagagctagtatatattacagctgtccctttggactcactccagaaacagctcagtgactcttagaggaagagaattttagaggccctaactggggcccagaaaattgtactgaaggatacttgcttcctgtgcatctccactatagtaaaatttgtttaaaattacgcttcttagccctcaaatccaaatggtctcttgagtgcttttgatttttctttaaccatccgtttcctactatttctactgctacctcgctttgttcaggcccttgttacattttcactagagtaatttcaacaatttagtttttctacctgctcttctatgctctaggattatagtgcataaaaaaaagtgcactatatatatagtgcaccccccccaccacccccagcataaaagaccctatcctgaaaaagttcatagcctaataggaggtcaaacatgactacagataattttaatgagtatgttgaggtacagttatagaaatacatataaaaggctgtggtaacatttaaaaagggagtaactgactctagaaatatttaaagtaactttcaactgcagtaataagaccattgaattattaacccagatttgaatcatgttgtttctgtagcaaatgtagagggaagttttgttctcctgttccaaatcagactaaagattcatttggtaatttaaaaatcagaaaagctttttttttctctctctctctcgttaatgggttgtaggggggtgaaagaaccgtctctgtctcctctggaggctcagtatttgagtccaagaaataaacttgacagtagacagattaacaggagaaaaggcatgtaaatgtatcgtatgcatatgcataggggtcctacaaagtatgagactcagataagggccagacggctgaagcttaaatagtacttttagctacagaaacaaatatgggcttaaggctcctggagggtgaggggaagaactgtactgtgaacgaaaattgtcttgctctgcggataaagtctctcagatagtagccctcagaagaataggtgaaaagtctgtatgggcctggtgtcttgggtgtgcggacctctagtctcctctcctgtgataggagttaatgtaaattccagagatggggttcacaattccattccttctggaggaacttccgtcttgataagggaaacttcagagaaagccctttcttcacttgaggagagaagatgaagagacagaggtacaggggaatgtcagaccttggttctgatgctgcttttttagttcaaagaactcatcatgtcaaagtgtcatactttggggtatagtttcctgacccctaacatgagcaaataaagagatgtaactgagttagccacaaaactatttttttctgttggctctatccaaaaatgagagtggaaaatgttctgtgaacatatatctaaaagtatgggtaaaacttgttttacaaactgttggtcattcagcaaacatttaaacagcttctatacttgtggaacataaataactagaaaatacaagctgcttattttagcaaattgtggctgtttgcattgctcaggctgccagttgtgccaattgtgctgaggtatgcttcaaaataactttctttcttatttttaatgactttttaatgcaggtacaatatcgatgttttaaaaacataagtatttggtgttttgttttgttttgttttgttttttgagatggagtttcgctcttgttgcccaggctagagtgcaatggcgcagtctcggctcactgcaacctctgcctcccaggttcaaacaattctcttgcctcagcctcccaagtagctgggattacaggctcccgccaccagggcccagctaatttttgtatttttagtagagacggggtttcaccatgttagccaggctggtctcaaactcttgacctcaggtgatctgccctcctcagcctcccaaagtgctaggattacaggcatgagccaccacgcctggcctaaaaacataagtattttaaacataatacacttttgaaattgaaacctgaactgaaatatataaaatatactttctgcatattttaaagtagttaagccagaaaacatcttaggctgtatttatagagactggtaatccatagtcaagtaatagttttctgtactctgccttggaaatactgattccagaatattgtagtagattttcattgccacattttgagatgaatattagcaaaagggcatatccaatgatggcaaaaatgagatggtaaactatcttgcctgaattatggttgaaggaattggtggaaaaagacccaggggaaattctaatagctttcaagtatgtgatgagatagagaaagtggaactgagggaatgaacaagataatttaggagtaactatgtttagggataacttcagaattactccacaaaaagttccctgtcaggcagtaagctcccagcaatgaaagtacccacttaaatcacttctgagatactttcctatttcaagattttaacttaagggcttaaagaacttaggttgacactgtataggactgtagtttgcagaggcagggtttgggataacttcttagccactgggcacttatgcggttgataccaggtaattctaatacattacagggatcagcaaactttttttctgcaagatgccagatagtaatattttaggctttgcaggccatatggtctctatagcatctgctcaactctgttgttgcagtgcaaaagtattgttgacattatgtaaacacagtttgttacctgtgttccaataaaactttatttacaaaagcaagtggtgagttggatttggcctgtgggtcatgctttgacgacccttgccttaactaatgaaatctagaaatagagttctaatgtaaatatagaaaggctttcaatctagggattaaaaatcgaactgtcaagatgtcattgtcttcttggtctgaaagagtacacatcaagtgttcaaaatagtgaattgcccaatgaattaagaaaccttccagtataaaagtcaaatgacaatggagaatctgatactgttttttactctttatttctgctacttaacgttgttcttaaaggcgtcgttacttctgctgggtagtactgtctactcagttggactgctgatgcagacccagtccataccaacaagttaacacaggttcaggccttctgagaaccaaaagatttttaagtacttccttcctaaatacagtaacttttaacagtaattttaacaccagaagcaagaagtaaacaaaaatctctgatgatcgaggcatctgttgtcatatattttgtgctcctaaggtcatacagcagagcctcttgtattatcttttggtctgttggcctttagtttatagtttgtaaaatggtggtcacatgtcaatgctgactagaagaaggagatgctactgtaatcaggcaggttggccttcgctgagaagtgaccattgattgctagaaaacaaagaaatgggaggcattcagcaacctggggttgttggttttaggaccagaaatgtacccccaagtctccaccaaatttctcaataatcctgaagagttttgctgtttgtgttttaatataacacagtaattggtgcttgtaatgaggactataattcatcaaaaaggtaaattgtgaattgtgcacacgcacacacactcttctaagcaaatgggactgctctattttgaacagtcttcaaattgaaataacttatttcgatatgtagaaaattaggataagcaaaaccaatttatttactcttaagagttccagatagtagtgatttgtcagtatgcatatgaatctttagtcctggcattctgaactcaaaacctcaatagagtggtttcttgacccttaaagtgttttatttttagtaaatacatttttaattctgtgacctcaaacctccaagctacattatgatttcataattttatagtgatttatccccccattgctttaaatttaataatcccatcctctttattggtatttaattttttctgtagtctaaaggcccttttatttaaaatgttatatattctgatttcttaattttagggatttttctctagacaattgagaatatgtaatttttacactttaatgttcatttgattataacctacacttgaaaagcaatttttaaagaaatctgagagaatttaaaaatcattttaaaagcatcatgtcatttttagctcaaaatacttcagagaatttattttattttattttttttggagacagggtcttgctctgttgcccaggctggaatgcagtggtgccatcacggcttgctgcagccttgacctcccaggctaaaatgatcctcccacctcagcctcctgagtacctgggaccataggcatgtgccaccacacctagctaatttgtttgtttttttgtagagatggggtcttgagcccaggctggtctcgaactcctcagctcaagggatcctgctgcctcagcctcccaaagtgctgggattacaggtgtgagccacaacccccagcccagagtctcctttttactaacggtgtacaacataaaattcaaactctaacatggttttacatctggcccctacctaccttttgcctctccttctttgtcacatactccacctgttcccatgcactttagactcaagtaatgaaaaacagcttgtattgctaggaacaggccgcattctttcatggtctgactttatacacactctcttgtggcaacctagaacacctgtctataggctctcttacatcaggccataccctttctgtgaaatttttaatctgtaatattctactgaaactttacctctctgaagccttccctaatctcctcaggcttttccattgttcatattctgtcttgtaacagttatcacattgttaaagtcgttccccagtaaactatgagacccttaactgtggaagggaaggcatctttttaacctttgtttttgtgccatacttagcctagagcctgacattaagcaggtacttctcaaaaaaaaaaaaaaaaaacacagggtagagacagataacaagggattcctgacacctacgctgtagatagctataacatttcaataggaatcttgggaatctggggaactggaagcagctgggaaagcaccggcatctgagccactcagtactcttccaggcttgtgtgtgagccttgccaccttcaggtattagcacttgaaatctaacttctttatgaagctccttatttacttgccttctcggtgaaaaaaaaaaacaacaacaaaaaccgtttccttccccatctggtgccagcactgtataattcctaataagcttgaaaagataatgttggcaatactttacaagtttattgctaatgtttaacatttattaggtgcttgctgtgtgctgatctctgtgcttacatatttttcatatatcacttcatctatcttcacaacagtccagtgaagtagatgccattattatcccaatttcacaaatgggaaaaatgagattcattgagataaattaaactacccaaggccatacaactatagactaagggggccaaaatttgaatctagtgtagattcaaattagagctcattctcttattcactactggggaatattgcctggccataactgaagtccaaataacagcatggttataatatgggctttaaaataatctagacctggattcaaaatccatttattggaggcaagtgacttcacttctgatcttcagttttctcatatgtaaaatgataatatctacctcaaaagtgttactgcccacccatgtacatggtacatactaaaaaagcaaatgttagttccatttgccacttctacactttatgtgaaccctgggggtaatggtttgtacagaataaggcctggcatgagaagacaaaaaccatctgacaaataaaaaagctgtcattctgtctaccagaatgtcaaccagtgcctgccttccaggatcaacaagtgttttattaccataatcacatttattctcttaatgaaaagggtgtgtcttgagtatttaatagttaattacccataaatatactacagtagaataaggaataaaaccagtgatctgtctactatagtaactaggtttctttcttggtaatacttagggaacatatgagggttccctgtgggttgttatttattatataaaatagttgctctggtagttccataatagagacctgtcagtgccattcagcagagaaaaatcataaacacagctgctgtttttgtgtggcttgtggttttggttttgttttcatttgaacttttttatgcaggcatgtcatcatttaaaagtagtcatttggcgttttcccttgcattcttcagattttttgtaggcttaaaaaaatttaagtcacttctataattgttcatacagattgatccatctggtctttttactagccaatgaaatttttgacatgtaggaaaaaggacaattattttaaattctataatttcagtggatctcttttataagtttgaagaaaaatagtttcaactatcaaaaaatatttttcttatattcttcattgtttcctgttaatttctgtattttcgtgggggctaaaaaggctaataatttctgctattcctactcttcacatcctttgtgtgttataactctgaagcataccataattatttgtttgcaaccaagaattggtacagcataaatgtctaatcaaattaggccctcttgctctctttaagtcacactggctatgaggtggaggtggattatagggggcaggcatcaattcagggagaccatttaggcctttgcagtggtccagacaagaaatattgatggccggcccaaggtactaagagtggtatttgaagaatgtagacagaataaagagagaattaacgaagcttgttgatgggttagatgttgattggtgtgagatggagagaggagtcagggatggcaggtttcctctcttctttcttgttgtgtttgttcaactcttgcttatcttttttttttctttgttttttgatggagtctcgctctgtcgcccagactggagtgcagtggagcgatctcggctcactgcaacctctgcctcccaggtttaagtgattctcctgcttcagcctcctgagtaggtgggattacaggtgcatgccaccacgcccagctaacttttgtatttttagtagagacggggtttcaccgtgttggtcaggctggtctcaaactcctgacctcgtgatctgcccacctcagcctcccaaaatgctaggattacaggtgtgagccaccatgcccagccacttatctttaaaggattaagtttatgtttcctactatgggaaaccatcccaccccaaacttgatgaccgcattatgtgcttttatagaacctggcacttctccaggatagcatttattctgttttgtaagtgtgaatgtaattaccctacacacagcatacacataatcttcatattctttgccttgtcttgtgaaggcaagggccatgtctatcttattcgtcattagattcccacatccaacatagtcctggggacagcaccaatgcacttttggtgcataagcaaatagtgtcatttatagctcttacctacaatatctgatagactaatcaaatatagtaggttatctgggcctttttgattcatgtctctagcttaactttcatttttttcttatttggtatctctcactttgccttttgatatactcttacagtttcgctcactgagtaaaagaaaatataaacagcaagaagtaaacttgtgttttatggattttgataacatcttctaaaagaccccccaagattgttgatgtctaaaaaaattaagggccttcaactcataataatacttaatagttcttaaaatattacaaactgattggaacattgcactaacagagagagtcatggatcttatttatgtgtagattcatttcagtcagaagtattaggactggtttatttgagaaagtaaatagatcattacaaattcatcgtcatacttcaaggaaaattcattgatgacactttctaatattgtgactatatacctaaatcatactttaagaacagaatgtctaagatatcacctagataagaatcaatacaaaaagaaaaaggaaaattacaaagattgatttaagaaagacaaaagactaagccataaaatttctcattattacaggttgagggcagggagtgaaaaaggaaaaggatttgacttctctaggcatggttttacttattttaaaataagagcagtggacccatgatctgaaagattgtttctggcctaaattctgtttttccgtaagatagaagagaatgataaaggtgatatgcaatgggaattttgggttgaattgcaacttacttttcattcttcccatagcctcatctctgtcttgatgaaaccttagagaatccactcaaatatagtgttttcttaaatgactttattaaatttaattaaatacaaatggtttttctaatctctgctgaaataaattctttgtagcctaatttagagcaacagtctagattagaatacttaagatgaattattactacttagcctaatcaagtcaaactatggaaaatgagtttttacattttagcagtgttataaatgtattcttctgtagttgtgtctcttttaacatatgttttccttctttgatttaggtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggtatgatacaatatcctattctaaaatgcaaataaccataaagcttaactgttgtccctttctaaaatatttctgtctaaaccaataccttcgtaatcttaaatagctttctaaataaaaatcataaatctaaagtatgttttactatcgaactatggaactatttttaacaccttgatattattccataaggttttatttaagaaatgtcatttgtgggatgacttagatttgttatatctcagtgttgttattcttttaaaaatgattgataggaatgtttgctgcctttgctctaaattgctgaatatattattttttatatattaaaaatattcaggactgtcaacttttaatatatatgcattcatcaaaaatttgttttaacctagcggtactttttttactttattgtgatcttccaaatctacagagttccctgtttgcaaaaaaaacatgttcatgctgtgtatgtaatagaatgttatattctttatgtaattttattaaaggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaaggtaagaaaatgactaatctactctaatcattactatagtgcagtcttctacctgtgtctatatctttgtatagtctttttttttttttccagctagatagtaagcttcttgaaggcagggactgcttatactgacaagatatagttgagtgctaaatagaaattatgtacaatcaatatttattggttgaatttttgtgtgaatatgatactgatttcttggtaaattgtctataaaacggaagaagtatgagtttgaaatttactattttttaggattcagaattagagctgattatcttttcataaataaaaactataaatagaaacattttatgaaattttgggaaaactttatacattcttgttattatatatcataaatacaccagaaaaaaataagtaattttcttaagtattaaatgcagtaattctgatcatgggtgataatatatagggagatttttgatatttaatatattagtttctagaattaagggaacaagaaactaaactatattgttttcaaaatgcatgtcattgtatcagataaatatctatatttttcagggtaacagtaaaattatcaatttgagttaactctcacacactattaaatatcaaattctgttagtagaataagttaagacatcttattactattcgtatttttcaaagtagtttaatgcaacataagatctttcaaaattcttttctattctagcatatattttaatgctcttttcattttcccgaacattctttgtgaaaaattttcaacatatagacaacttgaaagaaatgtactgtgaacaaccaaacctctctaaatagtttgtcttcccgttttcttcatctttctcttttcttcttttttggactcctggcttaatcttaaaaggagaaaattagacaatgcatttcctctcccctcgtaattttcttacctttcctccctcacattttctgtcattctaattgaacatctttaaacctccattggttctttctttacttcccatagttaccaaaaacttccaccttaggcactgtcaaacctttgagaccatcatgaatcactattcataggggcagtacccatgaagtatgtcatacagtttagaatggaaattagcttggtctcaggtacttgtgacccacatatcacagttttgtgtgcttgtcataaaacatgagatttgggaatgatctggcagcccgctcagatataaacattttctgtttctacctgatatttacctagttttaattgggctgattaaaaagcatttctgatatggataaagtaatgatagtgaatacttgttgaaatttctcccttgaaaaatgaaagagagatggtgattgcatctaatgttttcctgttatagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataaggtgagtaacaagtttcaaaatattaatttttaatttaaaaagtaatcacattgaggatgagtatctgtattttttttttttttttgagacggaatctcactctcgcccaggctggagtgcagtggcgcgatctcggctcactgcaggctctgcctcctgggttcatgccattctcctgcctcagcctcccgagcagctgggactacaggcgcccgccaccacacctggctaattttttgtatttttagtagagacaggttttgcaccatgttatctaggatagtcttgatctcctgacctcgtgatccactctccgtggcttcccaaagtgctgggattacagacgtgagccaccacgcccagccaagtatctatttttaggatatacttcttgataagtaatattagtaaatagcgtttgtaagcttattcttttaattctgtgattaattcgagaggctgaaaatgttggcagttactccagctcccaaatatagatattccatggggttgttgtttttgttgttgtttgtttgtttttcgagacagggtctcgctttgtctctcaggctggaatgcagtggtatgatcatggcttactgcagcatcagcctcccaggctcaagcagtcctctcacctcagcctcctaagtggctgggaccacatgcgtgtgccaccatgcccagctaatttttgtttgtttgtttgtttgtttagagacagagtctcatattgtccaggttggtctcgaattctgggcacaaacaatcctcctgccttggcctcccacagtgctgggattacaggcgtgagccattgcgcccagcctatttcgtgatttttatcccctccaaccagtggctgtggaatggaattgaaatagacatttcaaaaaatccatgacctactgttaagatatactattgatactttcctactctctttttctgtttattaaataaatacctataagaagcaactacgtttgtgccaagcatatgtcgagtactaatttacataaccaagtaaaacctgggcctggccttcaggttgcttattttctagtggggcttatgggtaagaaaataatgtgtatatagtaacatttatattaaaaatctcgtcttaactaccatttcaaaattcagaccagtatattttaacattttttgtaaatatccataatgttactggtctccactatttgtggttttttgttttaattttagcaaaactaatgtttctcaggaaatgtttggacaaaaaagcaagtgaacagcagcctttggatgggacatcagtatgacttaatagattgaatgacagaggcgtcctaagtgatattacttttctgttatcatatacaatgttttcataatgagtatcctgtgatccttgtttttttttttttttttttgagacggagtcttgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccacgcccggccgtgatccttgtttttaattcctttttttgcctccagttaagggtagaactacagtttcaaaagttgaccttaatttttttctttcgtgcaatttatattcagaagtgtttgattgatcttgtgcttcaacgtaaatcctaaatgttagtattttaaatgttataggaactactagtaaatgtggtctataatgtttaattttttatcacctttgcagattaatatgtagtcataatactctgacatgttacttttaaaatgaaaaaccttacaggaaatggctcgcccccttaatctcttacagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataaggtaaagtcaaatgctgatgcttattattttatagaaattattttagataacctttttcttgcactatacagtaatctgttgacctgtagtatgttttcagatggttaggagaacatccaaatctccgaatgtaaaaatatatcaagaattttacttgagcttccatctaccttagctattatacagctcacagtcctttgttaataattctaatattcacaattctagctcttaaaatcaaaagttttacagaattcgtttggcagaaagacctgggccaaccttaagtgagggtttttataatctttattaaccccacttagtataaaattccggtatcttattaaagaaatattaatgtctttatgaggtactgcttcaccagctaaggaagtagtatttagtaagtacgtgtaccaatttagctttctaaaatatggaaaaactctgaattacatacctcccttaaggggattgtgggcctatatttatgttttagtagtctgatgtctccattgttattagtggatgaaggcagcaactaattttggtgaagactctacatcagtattaacgtgttacatatgtgaaaaaaaggagaaccaagctatatctgaacaaaaattccgtggttttatatttgagtctatcgagtgtgtgcatatgtgtatgttgagtgtatacattagtatatacctacttttttcttttagatctatgttcgaacaggtatctaccatggaggagaacccttatgtgacaatgtgaacactcaaagagtaccttgttccaatcccaggtaaggaagtatatagatttatatttccaaaggttatattagtgtttagcagtatgatccataaaagtagtatatttttttagaccagcctgggcaacaaagcaagaccccatttctacaaaaagtttttcttaaaaattagctaggcactggccaggcacggtggctcatgcctgtaatcccagcgctttgggaggctgaggcgggtggatcacgaagtcggagtttgagaccagtctggccaagatggagaaaccccatctctactaaaaataaaaaaacattagccgggcgtggtggcgggcacctgtaatcccagctacttgggagactgaggcaggagaatcgcttgaacctggaaggctgaggttgcagtgagctgagattgtgccattgcactccagcctgggcaacagagcgagactccgtctcaaaaaaaaaaaaaaaaaaaaaaaaaaaaaaaaaaaattagctaggcacagtggcatgtgcctgtagtcccagccattagggaggctgagacaggagaataggagaattgcttgatcctggaagttccaggctgcagtcagctatgatcgtgccactgcattccagcattagtgagacctgatctcaaaatatatatatattttacatcattagctttatacaagctatatattaataaattaccagaaatgtacatatagaccagcaagactttctgtcaaatgagtatcagtcacaggattattttattgattctgtctaaagttttatcagaatagtttctgattgtctcttttcattgtatcaaagagagaacagagtatggttataattttatgctaatcattccccacattagattaaaaacctagcattttattcttttcctgtctccatcatcattcacatgaaggagaagtaagagttggcaagcaactccataaccaaactaccctgaggcagtttccttcaaatcactcccaagaatagatatttatggctttcaaataaagggtctttggtagcaaattaatttgttagtgggagagggagttatggggaacattttaaattattactgcctggatgtgatgaagaaataaaaagtagtataatccaatagctgactatcctgcatttctttgcttctctctatacagtcatttgggaataagagtacccctgaacgtaatagcagtaatatttcaagagaactcaaattgttattggactttatgataaaataacaatagagctaactagtgactcctccagaagtaaatctcataatgaatttagactgagttctaagacattcaagaaaaagttctggtcttgttgctaaagatggccacccttttagagcctaggtaaggttaaaagagatggtagccttgtctgccacagggaaggaagatagttcctcagcctacctaaaccactgtaggtcagaaaacgtatcattcaggtcagaaatgagattgtgacaacaaacaacttcaggatctttttttttttttttttttttttgagttgaagtctcaccctgtggcccaggctggagtacagtcaagtgtaagcgattctcctgcctcagcctccctagtagctgggactacaggcacatgccactgcgcccagcttattttttgtattttcagtagaggggggtttcaccatgttggccaggctggtcttgaacttctgacctcaggtgatcccacccaccttggcctcccaaagtgctgggattacaggcctgagccatcatgcccggccaggatctttttaaattcttgctaaaacaagagtttatatcccactcatactggtatgcctcacactgattagtggggtggttgtagcaggaaaagaaaaacaacatttgaggaaataatagccagaatttttccaaatttggtaaaaactataaacccgtcaatccaaggagttcaacaagccccaagcaaagaccccaaaataatactggatagaattatcctagctagctgtttcaagtaccacaagttaaactagctttataaaagtaaaaggctgggcgtggtggctcacgcctataatcccaacactttgggaagccaaggcagatggatcatttgagcccaggagtttgagaccaccctgggctatatggaaaaacacagtctctaccaaaaatacaaaaaattagcctgggatggtggtgtgtgtacctatagtcccagctactcaggagggtgaggtgggaggatcacctgagcccagggaggttgagactgcagtgagccatgatcgtactactgcagtccagtctagggggcagagtgagaccccgactcaaaaaaaaaaaaaaaagtaaaagataaacttatttaataatatatgattaaaatgttgaaatgttagtaaaatagctatttagaaaggactatatttgtctttaagcattctgtagtctaaaaggtgaagtatttatggtagtgtgaaaatttaagtaaactttttaaacttttctgtgcttacaaaaacaaaaatcagataaatgaatatgaagttattaaaaagatagaaaagtagattttaaaaattcttactaaatatttgtttcaaatctgtgcttcttttatgctaaattagatgctttatgatttctttgtaaatgttacaagtatctcccaaaatcagagtcaatttggactgtatacacacacacaaccattttctagaaataaagaacttaattgagcatgtgtatatgtgtgtgtgtctgtgtgttgtgggatggatggactttagaagaaaagagaaacatgctttattttgttagcatagggctgaacaagtagatttgtaggacatagctctcttagagtatagaacacttcttattaatttatgagcacttctaaagatttaggaataataaaaagtctggtacattaaagtaatatatctttaatttttcttttcttttttttttttttggaggcggagtcttgctctgtcgcccaggctggagtgcatggcacaaactcgactcactgcaacctctgcctcagcctcctgagtagctggagttacaggcgcccaccaccacgcccagctaatcttggcatttttagtagagatggggttttgccacgttggccagactggcttcgaactcctgacctcaggtgatccgtccaccttggcctcccaaagtgctgggattacaggtgtgagccaccatgcccagcctaattttttttaaatcattgcggacttaagtcccataatatttttctctatatgtttctacaattatatgtgttactgggcatggtagtatgcgcctgaaatcccagcaactcaggaggctaagggaggctgaggcaagaggatcacttgagcccaggagttcgaagctataatgcactttggtcatgcctgtgactagccactgcacttcagcctgggcacatagcaataccctatctctaaaaaataataataataataacatttgttttttcttttacctttagaattcttgccacatttccccattttaaatgtgtcttgtttctataaatagaccatatttttaaaaatctttatccatacttgagcaaaaatgctagaataaatggaacttattttactgatgaagtttattacttagttggctaattaaaaatagaattgttatactattttattgttgattaagaattattttatttataatcaagattagaccagaatgataagacatttgaaaagtttttaaaattactatctaacatatgagcttctatcatgggacaattgctattctaattcctttgcttgtgttatctcatttaattttatgagatagttatcaaccttatgagggtaggtactattattagtcccatttcatagaggaggcaaaagacaaagcaagggtcacacacttagtgaaaaaggggaaataagattctactccagtctgatttctgagcccatactctttatccattgttataatgtttttttaaaatacaaaactgtttattgtatgtggttctttacaaatatgttcaccaaagacagacataatttcacatgtagcacccagtaaattgagggaatttatcattaaaattcaaataattttttatcttgttcactttttgtagcagtgttttattcttcccttatgaatgtgaagtttcattaccttttataaaataattattcttcaattcaaatactttatgtatccatcattttatttacctactgatttatttagtggattcctttggataaaactatattatgtataaaagtaactaaatgtaatcataataggaaatcttattttacctttagttttccttttgtttgacttttatgagcaaaattatatatataaatatatagaaataataaatatatatttatattatgtatatagtatattatataatatatattataaatataaataagttttttagtgacgtatgtagcacacatgcataaaagtatacaaatcataattgtatagttcagtcacaaagtaaatacccatgtcttctgcttttaacaaatgcacacatttctgtggttttattcctacaattggagctgggtcacagggaatacatatgctcacttttattagattatgctttccaaattggttgtaacaaattataccccaatactcttagtgtatgagatttcctattactgcataaccttaccaccccttggcatcatcagtctttatagtttagccattcttatgtatagtgatatctccatgagattttaattttcattttctgtatgactaataatgactcccttttcatgtttattaactatttgaatatgaccttataaagtgccttttccaatcaatctctttcctgtttttcgtttggttgatctttgtcttcgtgatttgtaggagtcatttatatactttgatgaagacttttcttgatgtattatttttgctttaaaattttacataggtggaatgaatggctgaattatgatatatacattcctgatcttcctcgtgctgctcgactttgcctttccatttgctctgttaaaggccgaaagggtgctaaagaggtaaagtatttcagaaggaacaattatgtttacctttaaaaactcctgattataccgctgattgaattttttcacaaattggatgttattttatatttaagaaaataataataaacctatttttaaaattttaataaatgtatcatggaagaataccttgggagagcttcaggaatttatgatgaatatgttttgagttcttattgataccatttttaaaaatgcaaagtgactatataacagggattgcatgcaaatatctcatgcttgctttggttcatattttctatttataattaaaatacatgtaatttcaaatggggaaaaaggaaagaatgggcttaaaccttgaaaaatcaattttttttttttagatattcccattattatagagatgattgttgaattttccttttggggaagaaaagtgttttgaaatgtgttttataatttagactagtgaatatttttctttgttttttaaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagtaaggtttttattgtcataaattagatattttttatggcagtcaaaccttctctcttatgtatatataatagcttttcttccatctcttaggaaactccatgcttagagttggagtttgactggttcagcagtgtggtaaagttcccagatatgtcagtgattgaagagcatgccaattggtctgtatcccgagaagcaggatttagctattcccacgcaggactggtaaggcaaatcactgagtttattaagtatcaattataatctgtggatttaggtagatactttctctatggaaaaggatccatatattttactggcatagatactatgaactctaggaccaatattgcaatagaattaagttctctatatgctaatatttttactgcacctctgcttttttaaagccctagcttgccttcattcatttaacaaatatttattgaatgccgactatgtgtaaagcactgggaaaggcactaggtaataaagtcatgaactaaacagaccttcattgagtatgcactctaactgtgaaaacagacattaagcagataaaagcagaaatataagattacagttgacccttgaacaacatggatatgaactacactggtctacttatatgtggatttttttcaataaatatattggaaaattttttggagatttgtgacaatttgaaaaaaacttggagataaactacattgtccagaagtatcaaaaaaattgaagttaggtatgtcatgaatccataaaatatgtatagatacaagtctattttatcatttacgaccataaaatatacacaaatctattataaaaagttaaaatttatcaaaacatacacacacaaacacagaccatacatggtaccactcatagtcaagagaaatgcaaacatatataaagatgcagtattaaattgtatctgcataaaattaactgtagtacatactgtactactgtaataatttcatagccacctcctgttgctattgtagtaagctcaagcattgcatatatccacttaaaatgctatgtaggctgggtgcagtggctcatgcctgtaatcccagcactttgggaggccgaagcgggtgaatcacctgaggtcagagttcaaaaccagcctggcaaacatggtgaaatcccgtctctactaaaaatacaaaaagccgggtgtggtggcatgtgcctgtaatcccagctactcgggaggctaagttaggagaattgcttgaacccgggaggcagaggttgcagtgagccgaggtcacgccattgcactccagcctgggcaacagagcaagactccgtctcaaaaaacaaaacaaaacaaaatgctatgtaatgctgatcatctctacatgagtacttcatcacttcagtaaattgtttattgcagtgaaaagtgatctctcacagttcttggatatttttcatcatgtttagtgcaataccgtgaaccctgaataacactatgagggctgtaaggagtgcctctagtgatgctagaggtactctcaagaagcagagaaacgtcatgacgttacaagcaaaagttgaattgcttgatgtgtaccatatattgaggtctgcagctgcagttgcccttatttcagacagacaactaatcttgtaaacagacaacataaactttgtttgtttttgtttttttgagatggcgttttgctcttgttgctcaggctagagtgcaatggcacaatcttggctcactgcaacctctgcctcccgggttcaagtgatcctcctgcctcagcctcctgagtagctgggattacaggcatgcgccaccatgcccagctaatttttgtatttttaatagagacggggtgtctccatgttggtcaggctggtcttgaactcctgacttcatgtgatccacccgcctcggcctcccaaagtgctgggattacaggcgtgagccaccgcgcccggccaaactttttttttttaataagagatggggtaggtggatcacacctgtaatcctagcattttgggaggccgaggcgggtggatcacgaggtcaggagttcaagaccagcccggccaatatggtgaaaccccgtctctactaaaaataccaaaattagccaggcgttgttgtacatgcctgttagctactcaggaggctgaggcaggagaatcacttgaacctgggagatggaggttgcagtgagccgagattgcgccgctgcactccagcctgggcaacagagtgagactccgtctcaaaaaaacaaaaaacaagagagagatggggtctcactgtgttgcctgggctggtctcgaactcctgagctcaagtgatcctccctcccctacctcccaaagtgctaggattacaggtgtgagccatcatgcccggccaaaagacaaaataaatgtatagtatcagtaaatacagtacagtactgtaaatgaattttctcttccttatgattttcttaataacattttattttcactgtcttactctattgtaagaatataatgtatagtacatataccaagtaagtgttaatcaactgtttatatttctgttaagacttccaatctacagtagtcatttgtagttaagtttttggggagtcaaaatttacacatggattttcagttgtacaggagatcagttgcccctatcccctatattgtccaagggtcagctgtataaatcacattaagtgccaggaaggaaaaaacaatagtgagctaagaataactaactgaggatttgtggggaaaaggcaaatatatatatattgggttcaggaaagacctctctgagatgataaccttgaagttgagactgaagtacagctatacctctgaggtattgtgagtggtctagttctagaccactgtactaaagcagaaatcacaatagagtcacaaatgttttggtttcccagtgcatataaaagttctgttcacattatactgtcatctgtaaagtgtgtaatagtctgtcatctgtaaagtgtgtgatagccttacgtctaacacaacaatgtacatactttaaaaatattgctcaaaaatgctgatgatcatgcaaggcttcagcaagttgtaatctttttgctggtggagggtcttgcctcagtgttgatggctgctgacttaccaagctggtggttgctgaagtaacgttagcgtggctacagcagtttctttaagacgacagtgaagtttgccacattgattgacccttccttatgtgaaagatttctctgcagcatgtgatgctatttgatagcattttgcccacaatagaacttctttcagatttggagtcagtcctctcaaaacctgacgttacagttaaccagctgcattagcccctaacaagagagtcagcctgaagctttgaagccaggcattaacttctcttctctagctgtgaaagtcctagatggcatcttcttccattataagactgtttagtttacattgaaaatctgttgcttagtgtagccaccttcatcagttatcttggctagatcttctggataacttgcagcagcttctccatcagcacttgctgcttcacagcttcttttttaaacctcttataccaacctctgctagcttcaaacttttcctctgaagcatcttcgtctctctcaatattcatagaattgaaaagagttacggccttgctctggattaggctttgacttaaggaaaagttgtggctggtttgatcttctatctagaccactaaaactttctccatttcagcattaaggctgttttgttttcttatacttcattcactgaagtagcacttttaattttcttcaggaacttttcctttgcattcacaacttagctgtttggcaccagaggcctagccttggcctgtatggcttttgacatgcatttctcactaaacttaacatttctagcttttgatgtgaagcaagagacgtggcactcttcctgtcacttgaacacttagaggccattgtagggttattaattggcctaatttcaatattgttgtgtctcagggaatagggagtcctgagaggaggaagaaagaggagcaaaggttggtcggtgaagaagtcagaacatgcaacacttatcgaataagttcaccatcttaattggctcatggcacccccaactgcatcagagtaacatcaaagatcactgatctttgatcacagatcatcataatatataataataatgaaaagcttgaaatattataagaattaccaaaatgtgacacagagacaaaaaatgagccatgcatttggaaaaatagtgccaggagacttcctttacatagggataccaccacaaaccttcagtttgttggaaatgcaatatctgtgaggtatgataaagcaaagcacaataatacagggtacacctgcacaaatatattgttagttgagcttggaagcagagaaaacagcaggtcttcaccatgttatcccaggttccccaggaaagagcgtatgtaagatggaatttaaatattgatctagttgtctaatcttggccatagcttttgaaccacagtataattatctaggttcaagaaccattaactctccctgatttctcaagggcaaagatgtcaatgccacgagaagatgtttgtgttcattggtgtttccaaatatattactttttctttggctttgttggctatagataaaccagccaatgaattttgggccaagaagtccaaaacacccctatcccattaacagtaacagcagcatcaagaggcagcctggtatattgcacttaggaaatttattgattcatagctgtgttctcagtaaggcgtttaccactacttttcggaaaacaaattatcttttctgcatatatatttttctgcatttaaaagatacgagtctcttttttgagcagttctctttgtaagaattgatatttgatgactgtattctttcttaaaagaaattttatttcaaagaaaagaaatttgcttattttatagcagaataaaacttctatttttcagttacaatttgtatctattggaaacttttgtaaatctaagatacgacatggaatcttagtttttctgtatcttaaatattttactatttcatcatcctagaaattacttcatccatattcattatttccaactatgctaaaaaagactaaaataatatgaaaatataaaagaaggatagaatagcctagaaggacaataaaatagtgaagtaaatcatgatgttacatcatccttcagttttcttattgcattgcccagtgtcttgcatcatctttccagaagtatagaagaagtctgcagacactgtctttgtaatttttttgtttggttggttggtttctttcaggctttcattggacacttgagaattcagaatttttcacttttcacccagaatgatgacagatgaaaactgaccaaggaagatatttcacaagcattagacaaatcataatatgaatgtagatagatagtagcagcctagagcagagtttcccaacctcagcactattgacattttgcgccaaataattctttgttgtaggagccatcctgtgtgtgcaatccaggatgtttagcatccctgtcctctaccctactgcaggccagtagtgccatcctgctaagttatggctatcaaaaatgtctccagacattagccaaggttcctgggtggtcaaggggacacaaaatcaccctagttgagaaccactactctaaactctaatcatggtgaagtttattatataaatgaaatgtcagatgacaacacctaaactgtctctcagttatcttaagtcttctcaaactcaggataatgatgagtaaagaatatatttctaacaacaaaaaggaaatttgatagtatttctaaagacaaaaaggaaatttgtattcacattcagttagtcattccaccagaatgacttcatcacacaatattttgtgacaagaacctgaacagcctgttttacagtattcttttcatcttttattatatgcaccaaaatttttttttaaattttcttgaacctctaaatctacgttaaaaatttacctgatacactttctaaatggacaaatgccgaaggtagctgtgtatacaaatgtgactagaaggaaaaagatgatatagaaataaaataactccttgagttgatcattctgattggcatttatagagtagaaatgttttgtaattacagaggaaaaaagatggcctttccttcaacagttatgagccgtcagaattttcaaaaatactgcattttgacaatgtagtttctagtttgacaatgatatatttatcttcaaaaccaggaaaatgtagataagaatttggttttataatatttaaattcttattaaaatgtctaataaaattgttttccccatcactttattcttctgtaagttattttatatttaaaatgtaaacaaataaaaataagtaaataaacagtagcagcttcttttcctgataaatcgaggattgagtatgtattatctctttcctggactactggaataacctctccctccttccacagagaagccataataatctttatgaaatacaaatcaaatcatggtattcattctttaaatagctatcaataaaaataaaatcccaactttataccctgttcgcaaattttacgtggtctgaattcagcttacatttcttctttcccttgtctattgcccatcaggctcactggctttattccttcacaccaaactagttatttccggggtgggaggaaggcttgcagtgttttctccatctgcaatagtctttcccaaatcttagtgtggataaaggttccttcttgttacttgaatcacaaatactatgttctcagtcattctctgttacatcatccagagtacattatatcaattttccaatatttttatttatttgatttcccactataacagaggctctgttagtgcagggtcttttactattttgtaatcccaacagcaagaacaaaacaaggtacatagtacatatttaataaatacttgttgaacaaatatgtgccggtaatatttcttcatgctgctgaataagttaacagcatataaacacatacaaaccaagtggcatggatgtctgctttcatttttagccttttaaaaatatatgtaacccatcctaaggggtttatatttgttttgcataatacattaatatgtactcattattcattacacagttaatatatctatatttgcagggaatatacattgcttggaattatacaaaaaaatattatttttcgttttctaatattcaggatacagtgttttaatgggggtgtttcttcattctttttttcttactggtttttactttttaaatttgaaagctttgcagggatcataaggatctgttcaggcaaagaacatgaaagggtttacatttttatcattttagtgtttcttattctctatatcaaaaacattcacagataagttaacaagatcctcatcaggaggaaaagtaaattgttcactaccatcctctagtatcctaatctggtcttgttgttggctaacttcagcagttactattctgtgactggtgtaatattaaccaaataaattactggatttgttctacaaatattatgtcttagattggttctttcctgtctctgaaaataaagtcttgcaatgaaaataaattattttacaacagttaattagcaatgtaaaatttattgaaaatgtatttgctttttctgtaaatcatctgtgaatccagaggggaaaaatatgacaaagaaagctatataagatattattttattttacagagtaacagactagctagagacaatgaattaagggaaaatgacaaagaacagctcaaagcaatttctacacgagatcctctctctgaaatcactgagcaggagaaagattttctatggagtcacaggtaagtgctaaaatggagattctctgtttctttttctttattacagaaaaaataactgaatttggctgatctcagcatgtttttaccatacctattggaataaataaagcagaatttacatgatttttaaactataaacattgcctttttaaaaacaatggttgtaaattgatatttgtggaaaatcatactacattggtagttggcacattaaatgctttttcttactctgaattcctgatatgactttctttaggattgtttaaaatattctagtagttttaggtcaatttagatgtgatttagttggtctagatattataatttttaggggttccctttcatttttcttttttcttacgtttcttcaaatagtataatgccttattttcatttatgaagaaattaccctgctgttggtgatacgggtatatttaaataaaccagttgcagtgcatttctgcagaaagtccattaagacataaattttgtccagtaactacagtagaagtggtgactctatgattcattcatgttgcataagtaggtgaaaaatatgagctatatgaagagtggtataacatatattcataatttttcttaactgttaactaaatgtaagtacttataatccatttgcattttccttttgtgttctttgccattataactgtgcctaagtatatatgtaaatatatttccaactatagtgttaaacactgatgtcttttgaattttaaaaaagctagtaatgtaagaagtttgggacttcttaagaagattcatatggagaagttagacatgtcaaccttttgaacagcatgcaagaatgtttatgtttattttgtttctcccacacagacactattgtgtaactatccccgaaattctacccaaattgcttctgtctgttaaatggaattctagagatgaagtagcccaggtaaatgtatgtttgagattactagataactgttgtacaaattggtatgtcacttaaattgttttctctcagaaagtccacataaataaatgaaatagactaatagtaatatagtgtagaaaaaaacacccttaacattatttccatagataaaactaattagaactgtaaattctaaggagattatttatctaaactaattttaaaatcagaagttaaggcagtgttttagatggctcattcacaactatctttcccctttaaatatgatttattgtctttctcatacacagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtaaaataatgtaaaatagtaaataatgtttaattacaataataatttattctagatccatacaacttccttttaaaaaacctactgcactaactagttttatgcttaaaaaaaaaaattattaccagtaatatccactttctttctgaaaaaattttctttagatcggccatgcagaaactgaccctgatttgtttttttggaatcacctaggtcctaaaatatgaacaatatttggataacttgcttgtgagatttttactgaagaaagcattgactaatcaaaggattgggcactttttcttttggcatttaaagtaagtctaattattttcccattaaattcttaaggtacatattacttgctttcttaatagatttataaatatgtattacttatatacttttgtttatgtttggctggaagagttttccatactaaaagtattttgtaccagtgatgagcttctcaacttttgctctttgaaatttaaaaagcagtaaattcaaaactaaattttagtcatgaatgagagcttaaatatttttaaagatttttgttctacttaagtcaaattttctaggtccagatgaatattgctgtaggtttcactgtgtgtatggattacaatatccccaaacaaagaaaaaaatgttttaccttgaaattcagaacaatgtcaaactcccgtggttcttactgaaaaacaagctaattaagaataaaaaatgttttgtagaatgtgatatatgtagtactcaaaagttacaggtcataaaccatataacttttcataaatttagaagcagatttatatctaatatgatattttaagtgttaaaatttaataatggaacccagaagttaagttgaaaacaagaagcataggcgtgtgtcagaagagtcaaacagcattcactgagcgctttgttccctccctcttcatttgattatttttgtgctcaatttccttttttcatgtttttatatcttgtactgagattagtcaatgaaaactagttgaaataaacctaaaaactagatgtttatttaatcacatattcaggaactacctgaaactcatggtggttttgtttctaaattacaggttttgaataattttattattagtatgattgtaacatttattggatttcaaaaatgagtgtttaaattgtttagcaaagattatttgtatactgatttaagactatatatatatatttttaattttgcacgattcttttagatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtgtgtgactctagtttgtgtttgagactcttttcactgcagtggggcagagttgtttagaagcccagtgtatatacagatcatggtccttggaatcaagcagattaggatttggaaccaagttccactgcctctcagctgtgtagtgttagacacgtcatgcaggctctcaggactcattttctttgtctgtaaaatggaaataatacctgcttcataaggccattgtgagaattaaattacacgagatatgcaaagaacctatcacaatccttggaacatagaaggtggccaataaatgttagatccctttactttcccttcctttctcttattcaggtccctaagtatttacagtgattatttccttattctgtcatttattgtctctcagtaatgaccctgaaaatgagtggaaagaagttagtttttacatttccaagtttaaaatggatttcgagtcactcagtaaatatatcacactctagtcatctgctgtctagcttagtataactaagagtaggaaatacaatgtaaactttttttttttttttttttttttttttttgagacagggtctggctcttttgcctggcctggaatgcagtggtgcaatttcggctcactgcagccttgacctcctgggttcaagccatcctcccacctcagcctcctgagtagctaggactataggagcatgccaccacttccagctaatttttgtatttttagtagagacagtgtttcgctttgttgcccaggctggtctccaattcctgggctcaagcagtctgcccacctcggcctcccaaagtgctggaattacaggcatgagccactgtgcctagcccaatgtaaacttttttatgaccttttcctacaccctattctttattcaatccaatccaccacatcctaaattcaccacctcttacaattaaaaggaagctcattcctcacctctagtaaaaggaaaaaaaaaagaaaaatcgtatattagtgagtccccaaaggacagagaatgtaagttagcagtactgaatgaatttttccagcatcttcattactagtacttgaaggaaaaaaaaaaattaaaacaaagttattgtattaatgtaaatgtcatacagtgtgagttgattttattgaagtgtgatatataaattcaaatataggatggtagaaaataattgtactctttctgatactggaatttatgagcaagaagggtctagattgccctggaagaacaaaatttattgtatttatatattgtaactgagctgagaaaaaagaaactaaattttagatacatttgtaaatacagatgttcctcaacttataacagggttatatcctgataaacacatcataagttgaaaatatcgtacaggcaaaaatgggcattttgtagatgtgatgggatgcgaaaacacaaaacacagtatccaaaaaatgctggccacacagtacgctgtagactattggtcgtttaccctcatgactgcatggctgactgggagctgcggctcgctgctgctacccagcatctcaagaaaatactgtgttgcatatcactagcccaggaagagataaaagtttaaaatttgatgtatagtttctactgaatgcatgtaggaagagataaaagttcaaaatttgacatataatttctgaatgcatgttgctttcacaccatcacaaagttgaaaaatagtaagtcaaaaccattgtaagttggagaccatctgtgtaggcatttcttctaagctggagtttttatatcacaaattggctatgatacagtggattaattaggaacatgaaattcattactcagatcattattggcttaaatgagattttgatagggaactaagattgcagtcatagaaacaagagcagttactttgagtggctttgtgttttgttgtaacaatgagtgataaaatataagaagcattgtgctaacattagagttgtcagtgatagaaatgcctttacatgaacaagagctatctagtcagtgatgattagattttctaactattcatttgtatataacaagaagaaaaaaacttatttaaattccagcatgaaaattaatttattataattcctagctcctaaccactttttcccccactcacattttatattttcaataggtgaaagtttcctaaaataaaatcccagctattgcgtgataactcagcagtctgggctctgatttgaattgattaaaaagggatattgttttgtagccacatactaaaacctgaatatagtatgagactccatgtaacaaatgtttttacaagtccttttcccaacaatttcttttagcctcactagaccactttcacccagcaaagagagtatgaatgctgtgttttcttaaaagcctaaaagtaaggttattaagctaatgtaacatggtctccttagtttttcctctagaacacagatcagcaagttttcttaaagggccagatagtaactgttttagactttgcaggcccatgtggtctctgtcttaactattcaactctgctattctcgtaaaagcagccaatatgtaatgaatgggtgtagctatattctaatacaactcaatttacaaaaactggcagctgacctgccggttgactagccctgctctacagccaaaagcattgccactatcaccaagcagatttcatcttcttacaggaaggggtacacagtgctgccagtcttgcttctgtctctgagtgttgctgctctgtgttgtagaaaccctcttaattagaaagcagcagtctaggatgtagattcagagactgtacagtactgaggttctcatgtgagaaagagattagcagttagttttatcttttattaagtcagtttcttactgtgactatcctttttttttaatcaggtacagatgaagtttttagttgagcaaatgaggcgaccagatttcatggatgctctacagggctttctgtctcctctaaaccctgctcatcaactaggaaacctcaggtactttcttgggggtttcattgatatatttaaataaataccttttctggataaaatcttgagaaaagtaaaaatgtctgttataattagaatgttcaataatttatgcttctctctctcattctcctaccctcaaaataagagtagtatatcttaagttcagtactgcctttattcagaatgagtttttactacttaaataatacagtttaaaaccttctatggccagaatttctgttaccataggataagaaatggaaatgtaatatctgtaaaactaatgatatatctctatatatttgttggaaattcatatgcaattatataacttttaaaacttttagttttttttatactctttaggaatggattcctaaataaaaattgaggtgaaagttgtaaatctttgtaacacttcaaaaagctatattgtatttatattttaaaataaatttcagggtaaaataataataaagcaaaggtacctagtaaagtttttaactattttaaaggcttgaagagtgtcgaattatgtcctctgcaaaaaggccactgtggttgaattgggagaacccagacatcatgtcagagttactgtttcagaacaatgagatcatctttaaaaatggggatggtaaggaagagtattaatgagcttatgatgcatgaatttagctatctttttatacacaggatatttatgaaccatgaaaactactgaaagccatttaaggaatatacacatgtgataaaatatgtaatatttatcagatgtcttgacctttgaaatatgcatgtataatcaatgaaaagaaaagaagtactaggtttagatcagaagtcctgaaatcagttttttgttttttctttttcctgttccctgcctccaacccccctcccgtggacctgtgtagagaagtattttttgttgttgttttggttttttttttaatcagtttctaattatcatttgcttagctgtgtgagtatccattcattccataaatattctatgtgctaggccctggggttttagcagtgaagaaaacagaatccctgccctcttggagcttacagcctaacagagaaaagagggacattaaatgaataattacaaaaataaaattgcaagcatgttgcaaaggaagagtgtagtctgctcaggaaccatataaaagaaggtacttatatggaggaaaaggctatggggggagtgaaggaggatcatggatgggttttcaataggaaatgacatttcagcagtgaattctgttgatcccaatattttaatataaacatgtgttcaaatttaaggattcagaaaaataattactataaatgctttaattaaaaatttttgtgagatgcatgctcacttatcctacattgttattcaaatatgtttatgcaaagactttaaaagtggatttaagaatcagaatattaagagccatttgtagtggtgcatgcttgtgatcccagttgctctggaggattacttgagcccaggagttttagaccagcctgggcaacttagcaagaccccatctcaaaaaattataaatacattaataaagctatgtaaaggctttgagtggacatatacactcatttataaattttttgaaaagaaatcagaatattgctttcctgaagtttcttttgaagagtaaatatagctgtatttgtttttcatttgaaaaccatgtgatggcgtgatccccaaatttgcatctgtggcattaaatggtgatacatattatttgaatttcagatttacggcaagatatgctaacacttcaaattattcgtattatggaaaatatctggcaaaatcaaggtcttgatcttcggtaggtaaccagtaaggcaacctgtatgttgaaagttatcctgaaaaagtgaactattaataattatagaagcatatagaggcatatgtctaaaaagaaatgtatgcagtaattatcagtagttgattacactatagtactttgacatatcctcctcttacttagaatagctaaattatattcagctaagtaaaaagagctaataagctaataaacactctgctactgcctctggagtgtcaccattaggaacaagacaaaggagacacaaaagacccctgttttcattcagaaattaagagtttaaaagaaagtttcataatgggaattttctaattctaaaactgtataaatcctcaaatattggaatcagttttgcagcaaaattatgcaaccagctatcttagagtttttaccagtctgttggtttctacccaactttccacaatatcagtattatcaccaagttttctgtcatgcttcatcttctcctagtcattgttgcttctaaaatgttcttccttacctgacttgtctttttgcaaatccatagtcattcaggcaaagcccactctgtccaaagtattttggcctataagtggacatagagtcaagtctagctgtaacaacagggtacatttagtaggaattgcaggtaacaccagacaagggcttatttgtatgcctcttataaattttaagagtagctagtatacaaaaatgtgtcagtgacaaatagttgtacccttttattgcaaagaagaaagtggacatttcaggtgacctgctaaggcacaaaattgtcatcaacttcaaatttgtaactcctgatacgtagcttaacccctgctgctttccaaaaatggttaatgttatatgaatcaaatttcattttttggtataatttcctgtgtcatgagagatccacatgccactactaccatgtcccccaaaggaatagactgtaaaaaagattatagagctaagaaagagtaaaggagataaccgtgtaacgctggttaattacattgtttaattataaagtaatgactttgcaaaaaagcatctgaagttaagatgattagaaatattaatggttttttagtcttgtattttctgaatattttttaacttaagtaaatataagtaaaaattttatttcaagtttaactttagattaaaattatttaagtaaaatcataacagcatttttatttatacttggcaaaactataattcagaatcgggtttattttaaccctgcttcttttttttaataacaagacttagaagacaattaaattctgtaaactgtgagcatgttcaacagtgataaaaacataaaataagaaagaatgagcaggagtacaaccttaagatatttccctatttacgagggcaggtagaagaaaaggttgtgtaagagaagtcatcaaaggaagttggagtactagaggaagtgattgacaatttgtagggccagggcttcaagggggttaaaagaataaggcctgtgaaaaagcacttggatttagtgactcatcattagttttaagagtttactcactagagtggtaggtgtagaagctaggctacaaggaattaagtaagaaaatgaaaataagtattgaccgtattaggaatttaagaaataaaggaaaggtggaaaatatggagagtagcttacgagaagaacagagcaaggaaaaccaaactttggatacttacgtgtcaatctgaatgttaggtgctttttttcattgtctctttaaatcctcacatctgcacccttgactaagtgtcctatttaattttctatgtgaataaatgagaggtaccctaaaaagcatttgtgccacatcccaagtattatggttgtatcaaagggaaacatttgtgggattatttgagttgtgagctgaactagctgctgtttttatggaacacgatttttacttaaataactagtaggcaagctatggttattcagacatggatatttggcagacattttcttgaaaatgaacaatatgtgcctgtctctttgaagaaaacaactgtgacagtatttgttgccaatgataaaattcaaacttgcaacaaaaatttcattagaaattcaaaattagaattttgaaaattctaattttcattatctgccgctgaacctaatagagtccctaaacttaacatctttctgatgagattcttggtaatattaacaattgtggttttttagtatggtataatgaaaagtatcaacatttggaacatctacaaatgaccatgcaggatactataaaatcatgtatgggtaagagatccattaaaaggcaagaaagacaaattgattttaatgtaactgagtatgaaaagtttattgatacagttttagattacattttgcaacttaagaaacttatcttgtcaggttttagaatagtaccaaagaaaaatatcacaattatctgaaaagtctattataatactccttctttttctacctacctatctttgtgaggccagattttctttttatactttaattaaaacattgcattagattgcatacaaaagcatatatgagaatccagctgggtactatgaagccagacatttaaaaatttttttaaatgtgaaagaatttcactcttctcactaaattttttaaatgcattttttgtttcatgaaatatgttacttatattaacatgtcatagtttgttgcttttaaatgaattagtaaatatttaaaatttttattttccctatttcaatttctaatatcattagatgtaattcacataactaaaagctctttggagtcctcagtaatttctacaagtgtaaaggagtcctgagaccaaaattgagaacttctgccctacagttttatttcgatgtcaattaaacatctttaaattaacacatatttttaaaatcataaatgtttgtaaaattttaattgccacaataattttcttaattcttttctgataaaaatacagtgctttctcagttgaaggttataataaatgatgacaggtaattttgaggattattccaggagtatgtttatcacaccataaaaaagaaaattaaaattggggaaaggcagtaaaggtcatgcatgacaaatttactaataaaatactcatgttttagcctgttaaaacatttgctattttaaaattccatcatttaattgtaaacgtgttactcctctttcagaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatgtgagttgtattattctttcttcctatgttaatctaagtttttgttagatgagtctgtcggtgtttgtgtattcctctgagttagaacagagaaaacaattgtactttctatggaaaaaaatatgctcaacctttgaaatatttgatgttaatggatttaaatgattataattacttttaatttggtaaaatcttaaacattcatcttatgtattatctaaaatgtattgttattgcttattctttttaaaacaaatgaatattgcacattcaaaattttatttctaattcattgttaaaatgattagaaaaaaataattttaatgacatgctaagtattttttcacatgaagaattatgctttggtcagggaacatctggaaatttccttagaaacccatgaaaacttcacaatctcaaaatctttggacataatttccttattcgttgtcagtgattgttttcattgtttaaatggaaacttgcaccctgttttcttttctcaagttggcctgaatcactatatttccatactactcatgaggtgtttattctttgtagatatgatgcagccattgacctgtttacacgttcatgtgctggatactgtgtagctaccttcattttgggaattggagatcgtcacaatagtaacatcatggtgaaagacgatggacaagtaatggttttctctgtttaaaatgttttggtgttcttaatttattcaagacattttgtatctgcatatatcaaactataacataatttcttatttttgaaagctgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtgagctcgagcaattaaaaacacaaaataaagagttctggctgctctattagaaacaatcaatatttttcaagcaatttcaaaataataaatgttggctgggtgtggtggttcatgcctgtaatcccaactctttgggaggccgaggctggaggatcacttgagctcaggaattgaaaccagcctgggtaacatagagagaattcatgtctacaaaaaaatttaaaaagtagccaggcgtggtggcatgcactgtagtcccagctactcaggaggctgagatgggaggatcacttgagcccaggaggttgaggttgcagtgagccattatcacgccactgtactccaacctgggcaacagagtgagaccctgtatcaaaataaataaaatgaaataatagaagttcttttaccacttcagcaaaaactattttttgtttgttttttattctatcttatttcaatagcttttggggtacacgtggtttttgattacatggatgaattaaatagtggtaaagtctgagattttagcgcacctgtaacccaagtagtgtgctttgcccccagtatatacttttttatccctcactgttcttcccaccgtctcccatctgagtctctgtagtccattatatcactctgtatgcctttgtgtacctatagcttagctcccacttacaagtgagaacatactgtattttcaggttttccattcctggcctccagctccatcccagttgctgcaaaagacattatttcattcttttctgtggtggagtagtattctgtggtgtatatgtacactttctttatccactcattggtcagtgggtacttaacgttggtttcatatctttgcaattgtgaattgtgctgcagtaaacatacgatatgcatgcagatgcctttttgatataatgacttcttttcctctgggtagagggattcctggaccaaatggtagatctacttttagttctttaagaaatctccatactgttttccatagaggctgtactaatttacattcccaccaggagtgtataagcattctcatttcaccacatccatgtcaacatctgttgttttttgactttttaattatggccattcttgcaggagtaaggtggtatctcattgtggttttaatttgcatttccctgatgattaatgatgttgagcattttttcatgtttgttgaccatttatatatcttcttttgagaattgtctattcatgtccttagcccacttttttttttttttttttttttttttttgagatggagtctcactcttgttgcccaggctggagtacaatggcatgatctcagctcaccgcaacctccacctcctgggttcaaagcaattctcctgcctcagcctcccaagtagctgggactacaggcacatgccaccacacacggctaatttttgaatttttagtagagacggggtttcaccatgttggtcaggctggtcttgaattcctgacctcaggtgatccacccgcctcagcctccctaagtgctgggattacaggcttgagccactgcatcctgctttaacccactttttgatgggattctttgtttcttgctgatttgagttccttatagattctggatattagtcctttgtcagatgcatagtttgggaatattttctcccattctacgggttgtctgttaactttgatgattctttcttttgttatgcagaggctttttagtttaattaggtcccatttattttgtttgtttttgtcgcatttgcttttggggtcttagtcatttattatttgcctaggccagtgtttaaaagagtttttcctaagttatcttctagaatttttatggtttcaggtcttagatttaagtcttcgatccatcttgagttgatttttgtataaggtgagagacagggatccagtttcattcttttacatgtggctagctagttttcccaccaccatttattaaacagaatgtcctttctccaatttatgtttttatatgtctaagatcagttcgttgtaagtttttggctttatttctaggttctccattctgttccattggtctgtgtgtctgcttttgtgtgtatctgctgttttggtaattatagtttcctggtataatttgaagtccagtaatgtgatgcctccagatttgttctttttgcttagtcttgctttggctattcagactctttttggtcggttttatatgaattttaggatttttttttctaattctgtgaaaaatgatggtgacagtgttttgtagttttccttgaaaagatctttcacccccttggttaagtacattcctaggtatttttttgaagctaaaagggcttgtgttcttaatttgattctcagcttggttgttgttggtgtatagcaatgctgctgatttgtgtacactgattttgtaacctgagactttactgaattcatttatcaaatctaggagtctttttttttatcttttttaagacagagtcttgctctgtcccccaggctagagcgtagtggtgcgatctcagctcactgcaacctccacctcctgggtttaagcaattctcctgcctcagctttccaagtagctgggattacaggcatgcaccaccatgctcagctaatttttatattttttagtagagatggggtttcactttgttggccaggctggtcttgaactcccaatctcgggtgatcctcctgcctcggcttcccaaagtgctgggattatagaaatgagccaccacacctggctgaaatctaggaattttttggagaactcttgggttttctaggtatatgattatgtcattggtaaacagctatagtttgacttcctcttttccaatttggatgccaatgtgggcttccttgtcttgttctagttctcagggggagtgctttcagcttttccccattcagtatgatattggccgtgggtttgtcacatgacttttattattttgaggtaagtcccttctatgcctagtttgttgagtgaaaaactattttaattttttttttttgtatttatttgtgtgatgctgtgaaggaaaatggaaagggaatacaatttaatttgttgagctaattaaggcctaaaaagaaagtaatccttaaacttcataacacattaaaggtttttatttactgagctttaaatagttggactccacctctatattgacaaataatgtatagtgcttaatacgacattttttggtcatacactttgaggaaagtcagtcaaccataatcaccttgtttattcataacttttttaccaccttatggtatctcattagactatatcagactttaaagtactttttacaatcttctataaaattctgctttgtctacaacacagtcctgactctagcttaagcacaaaaggatttagtatgaaccaattcatacatttaatacttattaaactcctgacatgccaggcattgttgtaggtgctggtaataaagcagtttttaaaaagtccttattctcttgaagtttacattctagtggggtaaagggaatcaaaagatgttggtaagagaagtgagagaggaatgctatttttttatagctttgtctacgaaagcctctctaattttgtgacatttgagcaaagacctgaaggtattaacatcatttgctccaaactgaccaaactgttcttattacttataggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatccatatctccaaagtagaacattaaaccattttaagatatgtctcattcccaagtagtcagagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgtaaagtgtagttcttattaatcaggaaaatgatgacttgattagactgtatatgccctcttggattttattttaaatggattggtgactttcacataggtaaaacacagtccatctgtattcttttttccatcaaaaatcgagtgatttggaattataaaaaaattgtgagcagcctatttgaaaggcatcatggaaatttcacagcacaataacacggatttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgcacaaactgcagacctgggctggacccacatactcaagagtccaccttaagaaattattttgatgtccaagacatcactaaaatatttaagtttaaagataatatgtggtgttaatagattgtggtgcttttactatttaaagacaactttcatacttcagatgtttttgagaagaggggaatgtgaggggagggggcagaacagggaggagttgtttgaatgaattacattctttatatccatcctgctcatttggggcatgtctttaagagaaggctgaaagttgtgagagtatattgtataccgtaagagaatcaactcttcatcatggatgggattgtgaaggctgaactataaaattcagcattgacagcatcctcaattaataattcttggtgacagaataatacagctgggctgttttttaaaatataaacaataccatttttaattattacattaaaaattgtaaatatatctatgtgccatggcctgggaagcctgctttcttttttcataaaaattatttttactgtatgaaaagatcatggggtttagctcaaaatatctgtggtcctgataaaattggattggtaactctacctcagaaggaaaatgggaaaaaaaaatagatgagtcacaattcaatacttcaagctcagaaactgtgcagatcactgaattttagatttataaagtcagagttggcatgccttgtttttaatgatatggaagaccttaagaaaaaaacttggctgaagtttaatcgttggtccagccatttgaaaaaggcaatagtttgaggaggttcccgaattcggcatttgaaattcattttgttctctcttcttcattattagtgcatttggtgtgtgtatacttgcacacaattctgtttgtgtacacactgcttgcttagccctagtcaagaggcatcttttataaaaggtgtaaagaaatatcaaggttctaaaattcggaagagtttagaatttattaggagtttcccaagttgggatgttagtctttaaataaacttcatgcacctattccacttaaggttttgcacctcctttttattagtgcagtgccatttcttctgcttgattttaggtatgttaatattccagccttgctagttagcataaagtgacaggtgtgagccatgaggaaattttctgacttaatttgtacacaactacatataagagttttagtggaggaaaaaaattagtcccttgtgcgtatacagtagttaggtaaatgatttttctaccaacagtatactccattcctcatgtaggtaagtacagaaaaggtttttaaatgtatttttttagccagttaaagtctatgaatctatctgcaaccttatttaatctgtcactataataattttgtggttatgctaagaaccatgtatacttttaggtattcttatttttgtcaatttttctaggttggcaaggaggcagaaaaccttcattgtttcatattaaaatataattagactaaacttaattctagtatgaatttccaaaatcattatctatttatttcatttttatttaattttgtttttatttcatttttaaaagtcccttgttcaatttaacttatgttcctaagagaggttggagaacttggccttcatctgatttcaaaaatgttttgagtttcaaatgaagttaatggtttcagtgtgattcagtcctcagacctaattgggttgaataaaatctaaaagaatatacccttttggagcataacattttaataccttggggaatgtggcactaccaaaagaagactactaacacgtcagatgttcacctggaagctttatcaagaaattcgaaccacccttttggccccattaattgtagcaagtttatttctctatattttgtcattcagtgaattgaagtcctgtggtatactgcattcattagaagaaaaacgtttttaatgtccttttaatgatggcccagaaagcatttgacacagcaagatgcatgtgttactatattgagaatatagaataataacagtatcactaaatttaagacctcttcccagtcttgctgttcctagcaagaagtttggcctgtgactgcacttactgtttatgctcatcagaaactgtcaatgtctgcttttctttaactctgcagtctgtaacatcacgctgtttattaaaaaaaaaaagaaaaattactttttgtgtccaaacaatccttagtgtactacataagcaaaaaactgtgataattctcttttgccattccttttgaaaagcaagccggtgttgctaataatcaaaatttagctgaatttgagttcttttcagtaatgactaagaatacttgattgaaaatctgaaactattataccttaaaagccaatttttctaccccagtaaagtgatgaatattaaaggaatgtatgtttaaatatttacttcctttaagcataaagaattatatgcttgtattttaagaaatatatgtatatacatatatgtatgaatgtatgtatgtatatgcaataggtaagtagacttttttccaagtcgtttgaagatcagaacctagaaatgaagttaggctagaagcaaactggttttgctttcagttctcataaacattgcaaaaggtaagtgtgggcttttctttgaccattaatgcacataggcattaacaacttagtatttctgagcaattaagcaaataattacttaaattttatttatttgccaaatggtttaaataattttgaattgactttgttctccagggataatctctctctttgctggaatgaatcaggtagctcctatctaaatggaaaactgtggtaattgaaacacacgctttatattttaaattagcagttttgaatttgttagggaaaaaaaaaatcccagcaactgcatattgttaggtagaagtcaaatttacaaaaacggaatagagatgtgcccttgagaaaagtgtagaatctcaatgtgcagatgatttaaaatgtgcgtgcacatcaaatgttcatgtgtacttacatactttattacagagaagtctttggtatacaaaatagtttaccacaaccttttaaacagcaggttctgggccttaaatgcgtatcacatttagccaagagaactcaggtaggggcatggaaaatgaactgcagctccctatccctagcctctataccagctgtccagtgaaaagtaccaaggctcactgaatgttataacctagcagatttttaaataaatgatctaacatttttgagcactgctactagatgctagaagctaagctaaagtttcacctgccctactttgcttattccataaaataacaactgcgtgaaagaacgggttatccccattttatagatgagaaaagaaaggtttacacaggttagcttatttgcccaaagttgtaattatggcctacaaagtcaaataaatcctactctgagacacatgttctttccaccattgcacactagaaaggaaaacaccaagattattcattactcatcaagtcaatattgctgtattcagctaatttagtaatatgtgtcgaaattaattgctaaaagggattaaactgacttagaatcagttttttgtttgattacatctacatacaaaagtagcttcaaatgtctcattccactgtccataatttaagatttttgagtataataaaattttaaagatactttgaggcactttggaaaatcagaccaaaatctcttttccactcatagattcggcttaatcaacctggaaagcatttgttgagagccttatgacatcatttaataaccatggttgattcattaattaaagtacagacaattgttgactatccatgtgggacttcttttctattaggttgatgcaaaaataattgcggtttttcgccattaaaagttaacagcaaaaactggaattacttttgcaccagcctaatacgatgtggatcatctgagatgaatgttaaaatccagtatagcttcttcatatttctggcccatttttcccaccagaaagtgcacaaagtgaaatgagcttatgaaaagcttaattaactagaaaaatgttactgaaagaaaaattacatggtacatgacaaggctaaatactagtaactctaaacttagtgaattttctaggcagcagctttcctctgctgtctaga

SEQ ID NO: 6 - DNA, 3066 bp, Homo sapiens
atggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattct

SEQ ID NO: 7 - DNA, 5300 bp, Homo sapiens
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 8 - DNA, 3826 bp, Homo sapiens
gcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagg

SEQ ID NO: 9 - DNA, 7011 bp, Homo sapiens
atggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaa

SEQ ID NO: 10 - DNA, 9104 bp, Homo sapiens
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatccatatctccaaagtagaacattaaaccattttaagatatgtctcattcccaagtagtcagagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgtaaagtgtagttcttattaatcaggaaaatgatgacttgattagactgtatatgccctcttggattttattttaaatggattggtgactttcacataggtaaaacacagtccatctgtattcttttttccatcaaaaatcgagtgatttggaattataaaaaaattgtgagcagcctatttgaaaggcatcatggaaatttcacagcacaataacacggatttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgcacaaactgcagacctgggctggacccacatactcaagagtccaccttaagaaattattttgatgtccaagacatcactaaaatatttaagtttaaagataatatgtggtgttaatagattgtggtgcttttactatttaaagacaactttcatacttcagatgtttttgagaagaggggaatgtgaggggagggggcagaacagggaggagttgtttgaatgaattacattctttatatccatcctgctcatttggggcatgtctttaagagaaggctgaaagttgtgagagtatattgtataccgtaagagaatcaactcttcatcatggatgggattgtgaaggctgaactataaaattcagcattgacagcatcctcaattaataattcttggtgacagaataatacagctgggctgttttttaaaatataaacaataccatttttaattattacattaaaaattgtaaatatatctatgtgccatggcctgggaagcctgctttcttttttcataaaaattatttttactgtatgaaaagatcatggggtttagctcaaaatatctgtggtcctgataaaattggattggtaactctacctcagaaggaaaatgggaaaaaaaaatagatgagtcacaattcaatacttcaagctcagaaactgtgcagatcactgaattttagatttataaagtcagagttggcatgccttgtttttaatgatatggaagaccttaagaaaaaaacttggctgaagtttaatcgttggtccagccatttgaaaaaggcaatagtttgaggaggttcccgaattcggcatttgaaattcattttgttctctcttcttcattattagtgcatttggtgtgtgtatacttgcacacaattctgtttgtgtacacactgcttgcttagccctagtcaagaggcatcttttataaaaggtgtaaagaaatatcaaggttctaaaattcggaagagtttagaatttattaggagtttcccaagttgggatgttagtctttaaataaacttcatgcacctattccacttaaggttttgcacctcctttttattagtgcagtgccatttcttctgcttgattttaggtatgttaatattccagccttgctagttagcataaagtgacaggtgtgagccatgaggaaattttctgacttaatttgtacacaactacatataagagttttagtggaggaaaaaaattagtcccttgtgcgtatacagtagttaggtaaatgatttttctaccaacagtatactccattcctcatgtaggtaagtacagaaaaggtttttaaatgtatttttttagccagttaaagtctatgaatctatctgcaaccttatttaatctgtcactataataattttgtggttatgctaagaaccatgtatacttttaggtattcttatttttgtcaatttttctaggttggcaaggaggcagaaaaccttcattgtttcatattaaaatataattagactaaacttaattctagtatgaatttccaaaatcattatctatttatttcatttttatttaattttgtttttatttcatttttaaaagtcccttgttcaatttaacttatgttcctaagagaggttggagaacttggccttcatctgatttcaaaaatgttttgagtttcaaatgaagttaatggtttcagtgtgattcagtcctcagacctaattgggttgaataaaatctaaaagaatatacccttttggagcataacattttaataccttggggaatgtggcactaccaaaagaagactactaacacgtcagatgttcacctggaagctttatcaagaaattcgaaccacccttttggccccattaattgtagcaagtttatttctctatattttgtcattcagtgaattgaagtcctgtggtatactgcattcattagaagaaaaacgtttttaatgtccttttaatgatggcccagaaagcatttgacacagcaagatgcatgtgttactatattgagaatatagaataataacagtatcactaaatttaagacctcttcccagtcttgctgttcctagcaagaagtttggcctgtgactgcacttactgtttatgctcatcagaaactgtcaatgtctgcttttctttaactctgcagtctgtaacatcacgctgtttattaaaaaaaaaaagaaaaattaaaaaaaaaaaa

SEQ ID NO: 11 - protein, 480 aa, Homo sapiens [sequence omitted]

SEQ ID NO: 12 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 13 - protein, 399 aa, Homo sapiens
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 14 - protein, 1512 aa, Homo sapiens
MAAAAGNRASSSGFPGARATSPEAGGGGGALKASSAPAAAAGLLREAGSGGRERADWRRRQLRKVRSVELDQLPEQPLFLAASPPASSTSPSPEPADAAGSGTGFQPVAVPPPHGAASRGGAHLTESVAAPDSGASSPAAAEPGEKRAPAAEPSPAAAPAGREMENKETLKGLHKMDDRPEERMIREKLKATCMPAWKHEWLERRNRRGPVVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENSIKDEEEQMCPICLLGMLDEESLTVCEDGCRNKLHHHCMSIWAEECRRNREPLICPLCRSKWRSHDFYSHELSSPVDSPSSLRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSIDNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTVHLEKTGKGLCATKLSASSEDISERLASISVGPSSSTTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 15 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 16 - protein, 480 aa, Homo sapiens [sequence omitted]

SEQ ID NO: 17 - protein, 481 aa, Homo sapiens; identical to SEQ ID NO: 12

SEQ ID NO: 18 - protein, 399 aa, Homo sapiens; identical to SEQ ID NO: 13

SEQ ID NO: 19 - protein, 1512 aa, Homo sapiens; identical to SEQ ID NO: 14

SEQ ID NO: 20 - protein, 1068 aa, Homo sapiens; identical to SEQ ID NO: 15

The invention claimed is:

1. A method of treating a patient suffering from breast cancer, comprising:
   (a) determining, in a sample which is representative of the cancer and was previously isolated from the patient, whether the patient's sample comprises
      (i) a mutation selected from E17K, L52R, C77F, or Q79K in the patient's AKT1, AKT2, and/or AKT3 genes,
      (ii) a wildtype or mutant MAP3K1 gene, and
      (iii) a wildtype or mutant MAP2K4 gene;
   (b) detecting in the patient's sample a mutation selected from E17K, L52R, C77F, or Q79K in the patient's AKT1, AKT2, and/or AKT3 genes; a wildtype MAP3K1 gene; and a wildtype MAP2K4 gene; and
   (c) administering to the patient an effective amount of 4-amino-N-[(1S)-1-(4-chlorophenyl)-3-hydroxy-propyl]-1-(7H-pyrrolo[2,3-d]pyrimidin-4-yl)piperidine-4-carboxamide.

2. A method of treating a patient suffering from breast cancer, comprising:
   (a) determining whether the patient's cancer cells comprise:
      (i) a mutation selected from E17K, L52R, C77F, or Q79K in the patient's AKT1, AKT2, and/or AKT3 genes,
      (ii) a wildtype or mutant MAP3K1 gene, and
      (iii) a wildtype or mutant MAP2K4 gene;

(b) detecting in the patient's cancer cells a mutation selected from E17K, L52R, C77F, or Q79K in the patient's AKT1, AKT2, and/or AKT3 genes; a wildtype MAP3K1 gene; and a wildtype MAP2K4 gene; and (c) administering to the patient an effective amount of 4-amino-N-[(1S)-1-(4-chlorophenyl)-3-hydroxy-propyl]-1-(7H-pyrrolo[2,3-d]pyrimidin-4-yl)piperidine-4-carboxamide.

3. A method of treating breast cancer in a patient whose cancer cell gene status comprises (i) a mutation selected from E17K, L52R, C77F, or Q79K in the patient's AKT1, AKT2, and/or AKT3 gene, (ii) a wild type MAP3K1 gene, and (iii) a wild type MAP2K4 gene, the method comprising administering to the patient an effective amount of 4-amino-N-[(1S)-1-(4-chlorophenyl)-3-hydroxy-propyl]-1-(7H-pyrrolo[2,3-d]pyrimidin-4-yl)piperidine-4-carboxamide.

* * * * *